(12) United States Patent
Nisthal et al.

(10) Patent No.: US 11,859,012 B2
(45) Date of Patent: Jan. 2, 2024

(54) HETERODIMERIC ANTIBODIES THAT BIND CD3 AND GPC3

(71) Applicant: Xencor, Inc., Monrovia, CA (US)

(72) Inventors: Alex Nisthal, Monrovia, CA (US); Nargess Hassanzadeh-Kiabi, Monrovia, CA (US); Katrina Bykova, Seattle, WA (US); Matthew J. Bernett, Monrovia, CA (US); Rajat Varma, Bethesda, MD (US)

(73) Assignee: Xencor, Inc., Pasadena, CA (US)

( * ) Notice: Subject to any disclaimer, the term of this patent is extended or adjusted under 35 U.S.C. 154(b) by 0 days.

(21) Appl. No.: 17/692,045

(22) Filed: Mar. 10, 2022

(65) Prior Publication Data

US 2022/0306767 A1 Sep. 29, 2022

Related U.S. Application Data

(60) Provisional application No. 63/173,127, filed on Apr. 9, 2021, provisional application No. 63/159,058, filed on Mar. 10, 2021.

(51) Int. Cl.
| | |
|---|---|
| *C07K 16/46* | (2006.01) |
| *C07K 16/28* | (2006.01) |
| *A61K 39/00* | (2006.01) |
| *A61P 35/00* | (2006.01) |

(52) U.S. Cl.
CPC ............ *C07K 16/468* (2013.01); *A61P 35/00* (2018.01); *C07K 16/2809* (2013.01); *A61K 2039/505* (2013.01); *C07K 2317/31* (2013.01); *C07K 2317/55* (2013.01); *C07K 2317/565* (2013.01); *C07K 2317/567* (2013.01); *C07K 2317/622* (2013.01); *C07K 2317/92* (2013.01); *C07K 2317/94* (2013.01)

(58) Field of Classification Search
CPC .... C07K 16/468; C07K 16/2809; A61P 35/00
See application file for complete search history.

(56) References Cited

U.S. PATENT DOCUMENTS

| | | | |
|---|---|---|---|
| 3,773,919 A | 11/1973 | Boswell et al. | |
| 4,169,888 A | 10/1979 | Hanka et al. | |
| 4,179,337 A | 12/1979 | Davis et al. | |
| 4,256,746 A | 3/1981 | Miyashita et al. | |
| 4,294,757 A | 10/1981 | Asai | |
| 4,301,144 A | 11/1981 | Iwashita et al. | |
| 4,307,016 A | 12/1981 | Asai et al. | |
| 4,313,946 A | 2/1982 | Powell et al. | |
| 4,315,929 A | 2/1982 | Freedman et al. | |
| 4,322,348 A | 3/1982 | Asai et al. | |
| 4,331,598 A | 5/1982 | Hasegawa et al. | |
| 4,361,650 A | 5/1982 | Asai et al. | |
| 4,362,663 A | 12/1982 | Kida et al. | |
| 4,364,866 A | 12/1982 | Asai et al. | |
| 4,364,935 A | 12/1982 | Kung et al. | |
| 4,371,533 A | 2/1983 | Akimoto et al. | |
| 4,424,219 A | 1/1984 | Hashimoto et al. | |
| 4,450,254 A | 5/1984 | Isley et al. | |
| 4,496,689 A | 1/1985 | Mitra | |
| 4,640,835 A | 2/1987 | Shimizu et al. | |
| 4,670,417 A | 6/1987 | Iwasaki et al. | |
| 4,791,192 A | 12/1988 | Nakagawa et al. | |
| 4,880,935 A | 11/1989 | Thorpe | |
| 4,923,990 A | 5/1990 | Nakano et al. | |
| 4,943,533 A | 7/1990 | Mendelsohn et al. | |
| 4,970,198 A | 11/1990 | Lee et al. | |
| 5,053,394 A | 10/1991 | Ellestad et al. | |
| 5,070,092 A | 12/1991 | Kanda et al. | |
| 5,084,468 A | 1/1992 | Saito et al. | |
| 5,101,038 A | 3/1992 | Nakano et al. | |
| 5,122,368 A | 6/1992 | Greenfield et al. | |
| 5,187,186 A | 2/1993 | Kanda et al. | |
| 5,208,020 A | 5/1993 | Chari et al. | |
| 5,264,586 A | 11/1993 | Nicolaou et al. | |
| 5,384,412 A | 1/1995 | Nicolaou et al. | |
| 5,416,064 A | 5/1995 | Chari et al. | |
| 5,475,092 A | 12/1995 | Chari et al. | |
| 5,500,362 A | 3/1996 | Robinson et al. | |
| 5,530,101 A | 6/1996 | Queen et al. | |
| 5,541,087 A | 7/1996 | Lo et al. | |
| 5,550,246 A | 8/1996 | Nicolaou et al. | |

(Continued)

FOREIGN PATENT DOCUMENTS

| | | |
|---|---|---|
| CN | 107840891 A | 3/2018 |
| EP | 0425235 B1 | 9/1996 |

(Continued)

OTHER PUBLICATIONS

Shiraiwa H., et al., Engineering a bispecific antibody with a common light chain: Identification and optimization of an anti-CD3 epsilon and anti-GPC3 bispecific antibody, ERY974, Methods, vol. 154, pp. 10-20, ISSN 1046-2023, https://doi.org/10.1016/j.ymeth.2018.10.005 (Year: 2019).*

McCarthy et al., J. Immunol. Methods, 251(1-2): 137-149 (Year: 2001).*

Lin et al. (African Journal of Biotechnology, 10(79):18294-18302) (Year: 2011).*

(Continued)

*Primary Examiner* — Adam Weidner
*Assistant Examiner* — Ashley H. Gao
(74) *Attorney, Agent, or Firm* — Louis-Vu T. Nguyen; Christopher J. Betti; Morgan, Lewis & Bockius, LLP

(57) ABSTRACT

Provided herein are novel GPC3 binding domains, and antibodies that include such GPC3 binding domains (e.g., anti-GPC3×anti-CD3). Also provided herein are methods of using such antibodies for the treatment of GPC3-associated cancers.

5 Claims, 91 Drawing Sheets

Specification includes a Sequence Listing.

(56) References Cited

U.S. PATENT DOCUMENTS

| | | |
|---|---|---|
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,834,597 A | 11/1998 | Tso et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,177,078 B1 | 1/2001 | Lopez |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 7,850,962 B2 | 12/2010 | Teeling et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 9,181,334 B2 | 11/2015 | Kobayashi et al. |
| 9,822,181 B2 | 11/2017 | Bonvini et al. |
| 9,856,327 B2 | 1/2018 | Bernett et al. |
| 10,227,410 B2 | 3/2019 | Moore et al. |
| 10,428,155 B2 | 10/2019 | Moore et al. |
| 10,526,417 B2 | 1/2020 | Bernett et al. |
| 11,066,483 B2 | 7/2021 | Nezu et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winkel |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0100543 A1 | 5/2005 | Hansen et al. |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0004195 A1 | 1/2009 | Vranic et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |

(56) References Cited

U.S. PATENT DOCUMENTS

| | | |
|---|---|---|
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Kreudenstein et al. |
| 2013/0209355 A1 | 8/2013 | De Weers et al. |
| 2013/0267686 A1 | 10/2013 | Brinkmann |
| 2013/0336981 A1 | 12/2013 | De Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0161790 A1 | 6/2014 | Desjarlais et al. |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0119555 A1 | 4/2015 | Jung et al. |
| 2015/0307628 A1 | 10/2015 | Kim et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2016/0355608 A1 | 12/2016 | Bernett et al. |
| 2017/0020963 A1 | 1/2017 | Qu et al. |
| 2017/0320947 A1 | 11/2017 | Moore et al. |
| 2018/0118828 A1 | 5/2018 | Bernett et al. |
| 2018/0118836 A1 | 5/2018 | Bernett et al. |
| 2018/0127501 A1 | 5/2018 | Bernett et al. |
| 2018/0305465 A1 | 10/2018 | Stevens et al. |
| 2019/0106504 A1 | 4/2019 | Wu et al. |
| 2019/0263909 A1 | 8/2019 | Bernett et al. |
| 2019/0270816 A1 | 9/2019 | Bernett et al. |
| 2019/0314411 A1 | 10/2019 | Xiao et al. |
| 2019/0345252 A1 | 11/2019 | Kinsella et al. |
| 2019/0382495 A1 | 12/2019 | Bernett et al. |
| 2019/0389954 A1 | 12/2019 | Bernett et al. |
| 2021/0102002 A1 | 4/2021 | Bernett et al. |

FOREIGN PATENT DOCUMENTS

| | | |
|---|---|---|
| EP | 1752471 | 2/2007 |
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| EP | 3199628 A1 | 8/2017 |
| EP | 3252078 | 12/2017 |
| EP | 3339326 A1 | 6/2018 |
| RU | 2014114179 A | 10/2015 |
| WO | WO8705330 | 9/1987 |
| WO | WO9211018 | 7/1992 |
| WO | WO9321232 | 10/1993 |
| WO | WO9413804 | 5/1994 |
| WO | W09520045 | 1/1995 |
| WO | WO9640210 | 6/1996 |
| WO | WO96027011 | 9/1996 |
| WO | WO1997024373 | 7/1997 |
| WO | WO1997044352 A1 | 11/1997 |
| WO | WO99054440 | 10/1998 |
| WO | WO98050431 | 11/1998 |
| WO | WO199937791 | 7/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005103083 A2 | 11/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO 2006124641 A2 | 11/2006 |
| WO | WO2006106905 | 12/2006 |
| WO | WO2006131013 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007042309 A2 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO2007145941 A2 | 12/2007 |
| WO | WO20070147901 | 12/2007 |
| WO | WO2008003103 | 1/2008 |

(56) References Cited

FOREIGN PATENT DOCUMENTS

| | | |
|---|---|---|
| WO | WO2008003115 | 1/2008 |
| WO | WO2008003116 | 1/2008 |
| WO | WO2008048942 | 4/2008 |
| WO | WO2008119096 | 10/2008 |
| WO | WO2008119566 | 10/2008 |
| WO | WO2008124858 | 10/2008 |
| WO | WO 2008143684 A1 | 11/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010022737 A1 | 3/2010 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO 2011097603 A1 | 8/2011 |
| WO | WO2011121110 | 10/2011 |
| WO | WO2011131746 | 10/2011 |
| WO | WO2011133886 | 10/2011 |
| WO | WO2011143545 | 11/2011 |
| WO | WO2011154453 A1 | 12/2011 |
| WO | WO2011159877 | 12/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013018892 | 2/2013 |
| WO | WO2013022855 | 2/2013 |
| WO | WO2013023251 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013059885 A2 | 5/2013 |
| WO | WO2013063702 | 5/2013 |
| WO | WO2013070565 | 5/2013 |
| WO | WO2013096828 | 6/2013 |
| WO | WO2013125667 | 8/2013 |
| WO | WO2012173820 A2 | 11/2013 |
| WO | WO2013164694 | 11/2013 |
| WO | WO2013180201 | 12/2013 |
| WO | WO2014004586 | 1/2014 |
| WO | WO2014012085 | 1/2014 |
| WO | WO2014018572 | 1/2014 |
| WO | WO2014047231 | 3/2014 |
| WO | WO2014055897 A2 | 4/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014151910 A1 | 9/2014 |
| WO | WO2014164553 | 10/2014 |
| WO | WO2014207064 | 12/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015130728 A1 | 9/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2016014984 | 1/2016 |
| WO | WO2016028672 | 2/2016 |
| WO | WO2016028896 | 2/2016 |
| WO | WO2016040294 A2 | 3/2016 |
| WO | WO2016071355 A1 | 5/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016110584 | 7/2016 |
| WO | WO2016115274 | 7/2016 |
| WO | WO2016120789 | 8/2016 |
| WO | WO2016141387 | 9/2016 |
| WO | WO2017072366 A1 | 10/2016 |
| WO | WO2016182751 | 11/2016 |
| WO | WO2016210223 A1 | 12/2016 |
| WO | WO2017019846 | 2/2017 |
| WO | WO2017021356 A1 | 2/2017 |
| WO | WO2017023761 A1 | 2/2017 |
| WO | WO2017055391 A1 | 4/2017 |
| WO | WO2017112775 | 6/2017 |
| WO | WO2017134158 A1 | 8/2017 |
| WO | WO2017210443 | 12/2017 |
| WO | WO2017210485 | 12/2017 |
| WO | WO2017214092 | 12/2017 |
| WO | WO2017220990 A1 | 12/2017 |
| WO | WO2018005706 | 1/2018 |
| WO | WO2018017863 | 1/2018 |
| WO | WO2018041838 | 3/2018 |
| WO | WO2018209304 A1 | 11/2018 |
| WO | WO2019050521 | 3/2019 |
| WO | WO2019104075 A1 | 5/2019 |
| WO | WO2019173324 A1 | 9/2019 |
| WO | WO2019224718 A2 | 11/2019 |
| WO | WO2020023553 A1 | 1/2020 |
| WO | WO2020033702 A1 | 2/2020 |
| WO | WO2020236797 A1 | 11/2020 |
| WO | WO2021026387 A2 | 2/2021 |

OTHER PUBLICATIONS

U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.

(56) References Cited

OTHER PUBLICATIONS

"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Aplin et al., , Preparation, properties, and applications of carbohydrate conjugates of proteins and lipids, 1981, CRC Crit. Rev. Biochem., pp. 259-306.
Arnett, et al., Crystal structure of a human CD3-ε/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Bargou et al., Tumor Regression in Cancer Patients by Very Low Doses of a T Cell-Engaging Antibody, Science, 2008, vol. 321, pp. 974-977.
Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.
Bhatt, Sea Lane—DDD presentation, "Surrobodies ™—A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.
Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optimizing anti-CD3 affinity for effective T cell targeting against tumor cells.", Eur J Immunol. Nov. 2002; 32(11):3102-7.
Boswell et al., Effects of Charge on Antibody Tissue Distribution and Pharmacokinetics, 2010, Bioconjugate Chem, 21(21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann , et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.
Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.
Chothia et al., Canonical structures for the hypervariable regions of immunoglobulins, 1987, J. Mol. Biol. 196:901-917.

(56) References Cited

OTHER PUBLICATIONS

Chothia, et al., Structural Determinants in the Sequences of Immunoglobulin Variable Domain, J. Mol. Biol., 1998, vol. 278, pp. 457-479.

Chu et al., Immunotherapy with Long-Lived Anti-CD123 x Anti-CD3 Bispecific Antibodies Stimulates Potent T Cell Mediated Killing of Human AML Cell Lines and of CD123+ Cells In Monkeys: A Potential Therapy for Acute Myelogenous Leukemia, Blood 2014, 124:2316.

Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.

Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.

Chu et al., Reduction of total IgE by targeted coengagement of IgE B-cell receptor and FcγRIIb with Fc-engineered antibody., J Allergy Clin Immunol. Apr. 2012; 129(4):1102-15. doi: 10.1016/j.jaci.2011.11.029. Epub Jan. 16, 2012.

Conrad, et al., TCR and CD3 Antibody Cross-Reactivity in 44 Species, Cytometry Part A, 2007, vol. 71A, pp. 925-933.

Conrath, et al., Antigen Binding and Solubility Effects upon the Veneering of a Camel VHH in Framework-2 to Mimic a VH, J. Mol. Biol. , 2005, vol. 350, pp. 112-125.

Counterman et al., "Volumes of Individual Amino Acid Residues in Gas-Phase Peptide Ions.", J. Am. Chem. Soc., 1999, 121 (16), pp. 4031-4039.

Cuesta, et al., Multivalent antibodies: when design surpasses evolution, Trends in Biotechnology, 2010, vol. 28, No. 7, pp. 355-362, doi:10.1016/j.tibtech.2010.03.007.

D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.

Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.

Davila, et al., Efficacy and Toxicity Management of 19-28z Car T Cell Therapy in B Cell Acute Lymphoblastic Leukemia, Sci. Transl. Med., 2014, vol. 6, Issue 224, pp. 1-10, 224ra25.

Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.

De Groot et al., De-Immunization of Therapeutic Proteins by T-Cell Epitope Modification, 2005, Dev. In Biologicals, 2005, 122:171-194.

De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.

Del Nagro et al., A critical role for complement C3d and the B cell coreceptor (CD19/CD21) complex in the initiation of inflammatory arthritis., J Immunol. Oct. 15, 2005;175(8):5379-89.

Demarest et al., Antibody therapeutics, antibody engineering, and the merits of protein stability, Current Opinin in Drug Discovery & Development, 2008 11(5): 675-587, Sep. 11, 2008.

Deyev, et al., Multivalency: the hallmark of antibodies used for optimization of tumor targeting by design, BioEssays, 2008, vol. 30, pp. 904-918.

DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.

DiGiandomenico et al., A multifunctional bispecific antibody protects against Pseudomonas aeruginosa., Sci Transl Med. Nov. 12, 2014;6(262):262ra155. doc: 10.1126/scitranslmed.3009655.

Dixon, et al., Activation of Human T Lymphocytes by Crosslinking of Anti-CD3 Monoclonal Antibodies, Journal of Leukocyte Biology, 1989, vol. 46, pp. 214-220.

Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.

Doronina , Development of potent monoclonal antibody auristatin conjugates for cancer therapy, 2003, Nat Biotechnol 21(7):778-784.

Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.

Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.

Dubowchik et al., Receptor-mediated and enzyme-dependent targeting of cytotoxic anticancer drugs, 1999, Pharm. Therapeutics 83:67-123.

Ducry et al., Antibody-drug conjugates: linking cytotoxic payloads to monoclonal antibodies, 2010, Bioconjugate Chem. 21:5-13.

Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.

Duke, et al., Measurement of apoptosis and other forms of cell death, 2004, Curr protocols immunol. 3.17.1-3.17.16.

DukSin et al., Relationship of the structure and biological activity of the natural homologues of tunicamycin, 1982, J. Biol. Chem. 257:3105.

Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.

Edge et al., Deglycosylation of glycoproteins by trifluoromethanesulfonic acid, 1981, Anal. Biochem. 118:131.

Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.

Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.

Feldmann et al., Retargeting of T Cells to Prostate Stem Cell Antigen Expressing Tumor Cells: Comparison of Different Antibody Formats, Dec. 28, 2010.

Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.

Fischer, Nicolas et al., "Bispecifc antibodies: molecules that enable novel therapeutic strategies", 2007, vol. 74, pp. 3-14.

Foreman, et al., ErbB3 Inhibitory Surrobodies Inhibit Tumor Cell Proliferation In Vitro and In Vivo, Mol Cancer Ther, 2012, vol. 11(7) , pp. 1411-1420.

Foreman, et al., PEGS poster, "ErbB3 Inhibitory Surrobodies Inhibit Tumor Cell Proliferation In Vitro and In Vivo," 2012.

Fraker et al., Crystal structure of peptide cyclo-(D-VAL-L-PRO-L-VAL-D-PRO)$_3$, 1978, Biochem. Biophys. Res. Commun. 80(4):849-57.

Francois, et al., Construction of a Bispecific Antibody Reacting with the α- and β-Chains of the Human IL-2 Receptor, The Journal of Immunology, May 15, 1993, vol. 150, No. 10, pp. 4610-4619.

F-star Modular Antibodies Fact Sheet, Apr. 2008, "Modular Antibody Technology" (w/ reference to Ruker WO 2006/072620 A1).

(56) References Cited

OTHER PUBLICATIONS

F-star Modular Antibodies Press Release, Mar. 28, 2008, "Antibody Engineering Company F- Star Buys Back Royalty Obligations. TVM Capital Joins Investor Syndicate.".
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, Immunoglobulin heavy-chain VJ region [Mus musculus] Protein/NCBI.
GenBank AAA39180.1, Immunoglobulin light-chain VJ region [Mus musculus] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$- Segments in the Preferential Reassociation of Immunoglobulin Subunits, Molecular Immunology, 1986, vol. 23, No. 5, pp. 503-510.
Hawkins et al., Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.
Hennecke et al., "Non-repetitive single-chain Fv linkers selected by selectively infective phage (SIP) technology.", Protein Eng. May 1998; 11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.

Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jager, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, 5th Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.

(56) References Cited

OTHER PUBLICATIONS

Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014; 1844(11):1983-2001. doi: 10.1016/j.bbapap.2014.07.008. Epub Jul. 24, 2014.
Kipriyanov, et al., Bispecific CD3 x CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.

Labrijn, et al., Efficient generation of stable bispecific IgG1 by controlled Fab-arm exchange, www.pnas.org/cgi/doi/10.1073/pnas.1220145110 & Supporting Information.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Ling, et al., Interspecies Scaling of Therapeutic Monoclonal Antibodies: Initial Look, J Clin Pharmacol, 2009, vol. 49, pp. 1382-1402, doi: 10.1177/0091270009337134.
Link, et al., Production and Characterization of a Bispecific IgG Capable of Inducing T-Cell-Mediated Lysis of Malignant B Cells, Blood, 1993, vol. 81, No. 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.
Liu et al., Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.
Liu et al., Eradication of large colon tumor xenografts by targeted delivery of maytansinoids, 1996 Proc. Natl. Acad. Sci. USA 93:8618-8623.
Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.
Lode et al., Targeted therapy with a novel enediyne antibiotic calicheamicins $o^{I}_{1}$ effectively suppress growth and dissemination of liver metastases in a syngeneic model of murine neuroblastoma, 1998, Cancer Res. 58:2928.
Löffler, et al., A recombinant bispecific single-chain antibody, CD19 x CD3, induces rapid, and high lymphoma-directed cytotoxicity by unstimulated T lymphocytes, Blood, 2000, vol. 95, No. 6, pp. 2098-2103.
Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.
Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

(56) References Cited

OTHER PUBLICATIONS

Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.Immunol, 1996, vol. 43, pp. 134-139.

Mabry, et al., A dual-targeting PDGFRß/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.

Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.

Mandler et al., Modifications in synthesis strategy improve the yield and efficacy of geldanamycin-herceptin immunoconjugates, 2002, Bioconjugate Chem. 13:786-791).

Mandler et al., Synthesis and evaluation of antiproliferative activity of a geldanaymcin-herceptin™ immunoconjugates, 2000, Bioorganic & Med. Chem. Letters 10:1025-1028.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Marks et al., By-passing immunization: building high affinity human antibodies by chain shuffling, 1992, Biotechnology 10:779-783.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecific antibodies for dual-modality cancer therapy: killing two signaling cascades with one stone, Curr Opin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

Mateo et al., Humanization of a mouse nonoclonal antibody that blocks the epidermal growth factor receptor: recovery of antagonistic activity, 1997, Immunotechnology, 3(1):71-81.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

Mertens, Nico, "Tribodies: Fab-scFv fusion proteins as a platform to create multi-functional pharmaceuticals.", SpringerLink 2011, 135-149.

Metz, et al., Bispecific antibody derivatives with restricted binding functionalities that are activated by proteolytic processing, Protein Engineering, Design & Selection, 2012, vol. 25, No. 10, pp. 571-580.

Metz, et al., Bispecific digoxigenin-binding antibodies for targeted payload delivery, PNAS, 2011, vol. 108, No. 20, pp. 8194-8199.

Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.

Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.

Miller et al., Stability engineering of scFvs for the development of bispecific and multivalent antibodies, PEDS, 2010, vol. 23, No. 7, pp. 549-557 & Supplementary Data.

Miller, Biogen idec Stability Engineering and Production of IgG-like Bispecifc Antibodies, AAPS National Biotechnology Conference, Jun. 24 to Jun. 27, 2007.

Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".

Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.

Mimoto, et al., Novel asymmetrically engineered antibody Fc variant with superior FcγR binding affinity and specificity compared with afucosylated Fc variant, mAbs, 2013, vol. 5, Issue 2, pp. 229-236.

Modjtahedi et al., Phase I trial and tumour localization of the anti-EGFR monoclonal antibody ICR62 in head and neck or lung cancer, 1996, Br J Cancer, 73(2):228-35.

Modjtahedi et al., Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.

Modjtahedi et al., Antitumor activity of combinations of antibodies directed against different epitopes on the extracellular domain of the human EGF receptor, 1993, J. Cell Biophys. 1993, 22(1-3):129-46.

Modjtahedi et al., The human EGF receptor as a target for cancer therapy: six new rat mAbs against the receptor on the breast carcinoma MDA-MB 468, 1993, Br J Cancer. 1993, 67(2):247-53.

Mølhøj, et al., CD19-/CD3-bispecific antibody of the BiTE class is far superior to tandem diabody with respect to redirected tumor cell lysis, Molecular Immunology 2007, vol. 44, pp. 1935-1943.

Moore et al., Tuning T Cell Affinity Improves Efficacy and Safety of Anti-CD38 x Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.

Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.

Moore, et al., Application of dual affinity retargeting molecules to achieve optimal redirected T-cell killing of B-cell lymphoma, Blood, 2011, vol. 117, No. 17, pp. 4542-4551.

Moretti et al., BEAT® the bispecific challenge: a novel and efficient platform for the expression of bispecific IgGs. BMC Proceedings 2013 7(Suppl 6):09.

Morrison, et al., News and Views: Two heads are better than one, Nature Biotechnology, 2007, vol. 25, No. 11, pp. 1233-1234.

Mosmann, 1983, Rapid colorimetric assay for cellular growth and survival: application to proliferation and cytotoxicity assays, J. Immunol. Methods 65:55-63.

Muda, et al., Therapeutic assessment of SEED: a new engineered antibody platform designed to generate mono and bispecific antibodies, Protein Engineering, Design & Selection, 2011, vol. 24, No. 5, pp. 447-454.

(56) References Cited

OTHER PUBLICATIONS

Muramatsu et al., Production and characterization of an active single-chain variable fragment antibody recognizing CD25., Cancer Lett. Jul. 28, 2005;225(2):225-36. Epub Jan. 23, 2005.

Murthy et al., Binding of an antagonistic monoclonal antibody to an intact and fragmented EGF-receptor polypeptide, 1987, Arch Biochem Biophys. 252(2):549-60.

Nagorsen, et al., Blinatumomab: A historical perspective, Pharmacology & Therapeutics, 2012, vol. 136, pp. 334-342, http://dx.doi.org/10.1016/j.pharmthera.2012.07.013.

Nelson, et al., Point of View: Antibody fragments—Hope and hype, mAbs, 2010, vol. 2, Issue 1, pp. 77-83.

Neville et al., Enhancement of immunotoxin efficacy by acid-cleavable cross-ling agents utilizing diphtheria toxin and toxin mutants, 1989, Biol. Chem. 264:14653-14661.

Nielsen, et al., Human T cells resistant to complement lysis by bivalent antibody can be efficiently lysed by dimers of monovalent antibody, Blood, 2002, vol. 100, No. 12, pp. 4067-4073.

Nisonoff, et al., Letters to the Editors: Recombination of a Mixture of Univalent Antibody Fragments of Different Specificity, Arch. Biochem. Biophys., 1961, pp. 460-462.

Nisonoff, et al., Quantitative Estimation of the Hybridization of Rabbit Antibodies, Nature, 1962, vol. 194, No. 4826, pp. 355-359.

North, et al., A New Clustering of Antibody CDR Loop Conformations, J. Mol. Biol., 2011, vol. 406, pp. 228-256, doi:10.1016/j.jmb.2010.10.030.

O'Connor et al., Humanization of an antibody against human protein C and calcium-dependence involving framework residues, 1998, Protein Eng 11:321-8.

Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.

Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.

Page et al., 1993, Intermantional. Journal of Oncology 3:473-476.

Panke, et al., Quantification of cell surface proteins with bispecific antibodies, Protein Engineering, Design & Selection, 2013, vol. 26, No. 10, pp. 645-654.

Pessano, et al., The T3/T cell receptor complex: antigenic distinction between the two 20-kd T3 (T3-δ and T3-ε) subunits, The EMBO Journal, 1985, vol. 4, No. 2, pp. 337-344.

Pettit et al., Antineoplastic agents 365. Dolastatin 10 SAR probes, 1998, Anti-Cancer Drug Design 13:243-277.

Pettit et al., Dolastatins 24. Synthesis of (−)-dolastatin 10.1 X-ray molecular structure of N,N-dimethylvalyl-valyl-dolaisoleuine tert-butyl ester, 1996, J. Chem. Soc. Perkin Trans. 1 5:859-863.

Pettit et al., Specific activities of dolastatin 10 and peptide derivatives against Cryptococcus neoformans, 1998, Antimicrob. Agents Chemother. 42(11):2961-2965.

Pettit et al., Structure-activity studies with chiral isomers and with segments of the antimitotic marine peptide dolastation 10, 1989, J. Am. Chem. Soc. 111:5463-5465.

Pettit, et al., The dolastatins; 18: Sterospecific synthesis of dolaproine1, 1996, Synthesis 719-725.

Pichler et al., Differences of T-Cell Activation by the Anti-CD3 Antibodies Leu4 and BMA030, Mar. 30, 1987.

Potapov et al., Protein-Protein Recognition: Juxtaposition of Domain and Interface Cores in Immunoglobulins and Other Sandwich-like Proteins, J. Mol. Biol., 2004, vol. 342, pp. 665-679.

Presta et al., Humanization of an anti-vascular endothelial growth factor monoclonal antibody for the therapy of solid tumors and other disorders, 1997, Cancer Res.57(20):4593-9.

Queen et al., A humanized antibody that binds to the interleukin 2 receptor, 1989, Proc Natl Acad Sci, USA 86:10029-33.

Rader et al., A phage display approach for rapid antibody humanization: designed combinatorial V gene libraries, 1998, Proc. Natl. Acad. Sci. USA 95: 8910-8915.

Raghavan et al., Fc receptors and their interactios with immunoglobulins, 1996, Annu Rev Cell Dev Biol 12:181-220.

Rattel, et al., AACR Poster, "Validation of Cynomolgus Monkeys as Relevant Species for Safety Assessment of a Novel Human BiTE Antibody Platform for Cancer Therapy," 2010.

Reddy et al., Elimination of Fc receptor-dependent effector functions of a modified IgG4 monoclonal antibody to human CD4., J Immunol. Feb. 15, 2000;164(4):1925-33.

Reiter et al., Disulfide stabilization of antibody Fv: computer predictions and experimental evaluation, Protein Eng., 1995, vol. 8(12), pp. 1323-1331.

Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.

Remington's Pharmaceutical Sciences 16th edition, Osol, A. Ed. (1980) (Book Abstract).

Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.

Ridgway, et al., 'Knobs-into-holes' engineering of antibody CH3 domains for heavy chain heterodimerization, Protein Engineering, 1996, vol. 9, No. 7, pp. 617-621.

Riechmann et al., Reshaping human antibodies for therapy, 1988, Nature 332:323-329.

Riethmüller, Symmetry breaking: bispecific antibodies, the beginnings, and 50 years on, Cancer Immunity, 2012, vol. 12, p. 12, pp. 1-7.

Rodeck et al., Interactions between growth factor receptors and corresponding monoclonal antibodies in human tumors, 1987, J Cell Biochem. 35(4):315-20.

Roguska et al., Humanization of murine monoclonal antibodies through variable domain resurfacing, 1994, Proc. Natl. Acad. Sci. USA 91:969-973.

Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.

Roque et al., Antibodies and genetically engineered related molecules: production and purification, 2004, Biotechnol. Prog. 20:639-654.

Rose, et al., Mutation of Y407 in the CH3 domain dramatically alters glycosylation and structure of human IgG, mAbs, 2013, vol. 5, Issue 2, pp. 219-228.

Rose, et al., Quantitative Analysis of the Interaction Strength and Dynamics of Human IgG4 Half Molecules by Native Mass Spectrometry, Structure , 2011, vol. 19, pp. 1274-1282.

Rosok et al., A combinatorial library strategy for the rapid humanization of anticarcinoma BR 96 Fab, 1996, J. Biol. Chem. 271(37): 22611-22618.

Rossi, et al., A new class of bispecific antibodies to redirect T cells for cancer immunotherapy, mAbs 2014, vol. 6, Issue 2, pp. 381-391.

Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.

Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.

Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.

Salmeron et al., A conformational epitope expressed upon association of CD3-epsilon with either CD3-delta or CD3-gamma is the main target for recognition by anti-CD3 monoclonal antibodies, Nov. 1, 1991.

Sancho et al., CD3- Surface Expression Is Required for CD4-p56ick-mediated Up-regulation of T Cell Antigen Receptor-CD3 Signaling in T Cells, Apr. 16, 1992.

(56) References Cited

OTHER PUBLICATIONS

Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains as an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp 76-136, 1965, Academic Press.
Senter et al., Proceedings of the American Association for Cancer Research, 2004, vol. 45, Abstract No. 623.
Senter, Potent antibody drug conjugates for cancer therapy, 2009, Current Opin. Chem. Biol. 13:235.
Sforzini et al., Targeting of saporin to Hodgkin's lymphoma cells by anti-CD30 and anti-CD25 bispecific antibodies., Br J Haematol. Sep. 1998;102(4):1061-8.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human α/β T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-284.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shields et al., Lack of fucose on human IgG1 N-linked oligosaccharide improves binding to human FcγRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.
Soumyarani et al., Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.
Spiess, et al., Bispecific antibodies with natural architecture produced by co-culture of bacteria expressing two distinct half-antibodies, Nature Biotechnology, 2013, doi:10.1038/nbt.2621 & Supplemental Information.
Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.
Stamova, Unexpected recombinations in single chain bispecific anti-CD3-anti-CD33 antibodies can be avoided by a novel linker module, Oct. 29, 2011.
Stanfield, et al., Maturation of Shark Single-domain (IgNAR) Antibodies: Evidence for Induced-fit Binding, J. Mol. Biol., 2007, vol. 367, pp. 358-372.
Stewart, et al., Recombinant CD36 inhibits oxLDL-induced ICAM-1-dependent monocyte adhesion., Mol Immunol. Feb. 2006;43(3):255-67.
Strop, P. et al., Generating Bispecific Human IgG1 and IgG2 Antibodies from Any Antibody Pair, J. Mol. Biol., 2012, doi:10.1016/j.jmb.2012.04.020.
Szymkowski et al., Creating the next generation of protein therapeutics through rational drug design, Current opinion in drug discovery & development, Sep. 1, 2005, p. 590, XP055354917, England.
Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.
Tan et al., "Superhumanized" antibodies: reduction of immunogenic potential by complementarity-determining region grafting with human germline sequences: application to an anti-CD28, 2002, J. Immunol. 169:1119-1125.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-9258.
Tarcsa et al., Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.
Teachey, et al., Cytokine release syndrome after blinatumomab treatment related to abnormal macrophage activation and ameliorated with cytokine-directed therapy, Blood, 2013, vol. 121, No. 26, pp. 5154-5157.
Tedgui, et al., Cytokines in atherosclerosis: pathogenic and regulatory pathways., Physiol Rev. Apr. 2006;86(2):515-81.
Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.
Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.

(56) References Cited

OTHER PUBLICATIONS

Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013; 123(5):2218-30. doi: 10.1172/JCI65861. Epub Apr. 24, 2013.
Tomlinson et. al., Methods for generating multivalent and bispecific antibody fragments, 2000, Methods Enzymol. 326:461-479.
Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
Van Boxel, et al., Some lessons from the systematic production and structural analysis of soluble $\alpha\beta$ T-cell receptors, Journal of Immunological Methods, 2009, vol. 350, pp. 14-21.
Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.
Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.
Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.
Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.
Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.
Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.
Whitlow, et al., An improved linker for single-chain Fv with reduced aggregation and enhanced proteolytic stability, Protein Engineering, 1993, vol. 6 , No. 8, pp. 989-995.
Wigginton et al., An immunoglobulin E-reactive chimeric human immunoglobulin G1 anti-idiotype inhibits basophil degranulation through cross-linking of FcεRI with FcγRIIb., Clinical & Experimental Allergy, 38: 313-319.
Wong, et al., The Mechanism of Anti-CD3 Monoclonal Antibodies, Transplantation, 1990, vol. 50, No. 4, pp. 683-689.
Woods, et al., LC-MS characterization and purity assessment of a prototype bispecific antibody, mAbs, 2013, vol. 5, Issue 5, pp. 711-722, http://dx.doi.org/10.4161/mabs.25488.
Woyke et al., In vitro activities and postantifungal effects of the potent dolastation 10 derivative auristatin PHE, 2001, Antimicrob. Agents and Chemother. 45(12):3580-3584.
Wu et al, Molecular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.
Wu et al, Simultaneous targeting of multiple disease mediators by a dual-variable-domain immunoglobulin, (DVD-Ig™) molecules, Jul.-Aug. 2009; 339-347, Oct. 14, 2007.
Wu et al., Humanization of a murine monoclonal antibody by simultaneous optimization of framework and CDR residues, 1999, J. Mol. Biol. 294:151-162.
Wu, et al., Multimerization of a chimeric anti-CD20 single-chain Fv-Fc fusion protein is mediated through variable domain exchange, Protein Engineering, 2001, vol. 14, No. 12, pp. 1025-1033.
Wucherpfennig, et al., Structural Biology of the T-cell Receptor: Insights into Receptor Assembly, Ligand Recognition, and Initiation of Signaling, Cold Spring Harb Perspect Biol 2010;2:a005140.
Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.
Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.
Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (Macaca fascicularis) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zalevsky et al. "Enhanced antibody half-life improves in vivo activity." Nature Biotechnology, vol. 28, No. 2, Feb. 1, 2010, pp. 157-159.
Zamyatnin AA., Amino acid, peptide, and protein vol. in solution., Annu Rev Biophys Bioeng. 1984;13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

(56) References Cited

OTHER PUBLICATIONS

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.
Zhu, et al., Remodeling domain interfaces to enhance heterodimer formation, Protein Science, 1997, vol. 6, pp. 781-788.
Zeibig et al., Effect of the oxLDL Binding Protein Fc-CD68 on Plaque Extension and Vulnerability in Atherosclerosis., Circulation Research 108: 695-703, 2011.
Zuo, et al., An efficient route to the production of an IgG-like bispecific antibody, Protein Engineering, 2000, vol. 13, No. 5, pp. 361-367.
Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.
Capizzi et al., Curative chemotherapy for acute myeloid leukemia: the development of high-dose ara-C from the laboratory to bedside., Invest New Drugs. 1996;14(3):249-56.
Giles et al., Intravenous corticosteroids to reduce gemtuzumab ozogamicin infusion reactions. Ann Pharmacother. Sep. 2003;37(9):1182-5.
Duong et al., Targeted treatment of acute myeloid leukemia in older adults: role of gemtuzumab ozogamicin., Clin Interv Aging. 2009;4:197-205. Epub May 14, 2009.
Sun et al., Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.
Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.
Zhang et al., The development of bispecific antibodies and their applications in tumor immune escape., Experimental Hematology & Oncology20176:12.
Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.
Osada et al., CEA/CD3-bispecific T cell-engaging (BITE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.
Masarova et al., Immune Checkpoint Approaches in AML and Mds: A Next Frontier?, The Journal of Targeted Therapies in Cancer, Mar. 6, 2017 (Mar. 6, 2017), XP002784099.
Scott et al., Antibody therapy of cancer., Nat Rev Cancer. Mar. 22, 2012;12(4):278-87. doi: 10.1038/nrc3236.
Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.
Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.
Fos et al., ICOS ligation recruits the p50alpha PI3K regulatory subunit to the immunological synapse., J Immunol. Aug. 1, 2008;181(3):1969-77.
Sanmamed et al.,Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol. 2015.05.014. Epub Jun. 11, 2015.
Vieira et al., ICOS-mediated signaling regulates cytokine production by human T cells and provides a unique signal to selectively control the clonal expansion of Th2 helper cells., Eur J Immunol. May 2004:34(5):1282-90.
Madrenas et al., Conversion of CTLA-4 from inhibitor to activator of T cells with a bispecific tandem single-chain Fv ligand., J Immunol. May 15, 2004;172(10):5948-56.
Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09. 006.
Carpenter et al., Activation of human B cells by the agonist CD40 antibody CP-870,893 and augmentation with simultaneous toll-like receptor 9 stimulation., J Transl Med. Nov. 11, 2009;7:93. doi: 10.1186/1479-5876-7-93.
Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.
Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.
Uy et al., Preliminary Results of a Phase 1 Study of Flotetuzumab, a CD123 x CD3 Bispecific Dart® Protein, in Patients with Relapsed/Refractory Acute Myeloid Leukemia and Myelodysplastic Syndrome., Blood 2017 130:637.
Vey et al., Interim Results from a Phase 1 First-in-Human study of flotetuzumab, a CD123 x CD3 bispecific DART molecule, in AML/MDS., Annals of Oncology (2017) 28 (suppl_5): v355-v371. 10.1093/annonc/mdx373.
Ravandi et al., Complete Responses in Relapsed/Refractory Acute Myeloid Leukemia (AML) Patients on a Weekly Dosing Schedule of XmAb14045, a CD123 x CD3 T Cell-Engaging Bispecific Antibody: Initial Results of a Phase 1 Study., Blood 2018 132:763; doi: https://doi.org/10.1182/blood-2018-99-119786.
Bacac et al., A Novel Carcinoembryonic Antigen T-Cell Bispecific Antibody (CEA TCB) for the Treatment of Solid Tumors., Clin Cancer Res. Jul. 1, 2016;22(13):3286-97.
Schuster et al., Immunotherapy with the trifunctional anti-CD20 x anti-CD3 antibody FBTA05 (Lymphomun) in paediatric high-risk patients with recurrent CD20-positive B cell malignancies., Br J Haematol. Apr. 2015;169(1):90-102. doi: 10.1111/bjh.13242. Epub Dec. 11, 2014.
Shields et al; "High Resolution Mapping of the Binding Site on Human IgG 1 for FcγRI, FcγRII, FcγRIII, and FcRn and Design of IgG1 Variants with Improved Binding to the FcγR*", The Journal of Biological Chemistry, 2001, 276(2):6591-6604.
Szymkowski et al; "Anti-CD38—anti-CD3 bispecific antibody in multiple myeloma" , Xencor, pp. 1-15. Mar. 28, 2014.
Human Somatostatin R2/SSTR2 Antibody, MAB4224: R&D Systems, https://www.rnndsystems.com/products/human-somatostatin-r2-sstr2-antibody-402038_mab4224#product-details, Rev. Feb. 7, 201.
Julg, B. et al "Enhanced Anti-HIV Functional Activity Associated with Gag-Specific CD8 T-Cell Responses." Journal of Virology 84.11 (2010): 5540-5549. Web. Jul. 13, 2020.
Tutt et al., Trispecific F(ab')3 derivatives that use cooperative signaling via the TCR/CD3 complex and CD2 to activate and redirect resting cytotoxic T cells., The Journal of Immunology Jul. 1, 1991, 147 (1) 60-69.
Armour et al., Recombinant human IgG molecules lacking Fcv receptor I binding and monocyte triggering activities., Eur. J. Immunol. 1999. 29: 2613-2624.
Bogolyubova et al. , Cancer immunotherapy based on the blockade of immune checkpoints, Oct. 2015, Medical Immunology (Russia) 17(5):395.
Schanzer et al., "A Novel Glycoengineered Bispecific Antibody Format for Targeted Inhibition of Epidermal Growth Factor Receptor (EGFR) and Insulin-like Growth Factor Receptor Type I (IGF-1 R) Demonstrating Unique Molecular Properties", Journal of Biological Chemistry, vol. 289, No. 27, May 19, 2014 (May 19, 2014), pp. 18693-18706.
Volker Baum et al, "Antitumor activities of PSMA x CD3 diabodies by redirected T-cell lysis of prostate cancer cells", Immunotherapy, vol. 5, No. 1, pp. 27-38, Jan. 31, 2013.

(56) References Cited

OTHER PUBLICATIONS

Stewart et al., "The role of Fc gamma receptors in the activity of immunomodulatory antibodies for cancer", Journal for Immunotherapy of Cancer, Biomed Central, London, UK, vol. 2, No. 1, Aug. 19, 2014 (Aug. 19, 2014), p. 29.
Moore et al., A robust heterodimeric Fc platform engineered for efficient development of bispecific antibodies of multiple formats., Methods. Feb. 1, 2019;154:38-50. doi:10.1016/j.ymeth.2018.10.006. Epub Oct. 23, 2018.
Celine Monnet et al: "Selection of IgG variants with increased FcRn binding using random and directed mutagenesis: impact on effector functions", Frontiers in Immunology, vol. 6, No. 39, Feb. 4, 2015 (Feb. 4, 2015), pp. 1-14, XP055238838, DOI: 10.3389/fimmu.2015.00039.
Sondermann Peter et al: "Harnessing Fc receptor biology in the design of therapeutic antibodies", Current Opinion in Immunology, Elsevier, Oxford, GB, vol. 40, Mar. 30, 2016 (Mar. 30, 2016), pp. 78-87, XP029551351, ISSN: 0952-7915, DOI: 10.1016/J.COI.2016.03.005.
Deckert et al., "A Novel Humanized CD38-Targeting Antibody, Demonstrates Potent Antitumor Activity in Models of Multiple Myeloma and Other CD38+ Hematologic Malignancies", Clinical Cancer Research, vol. 20, No. 17, pp. 4574-4583 (Sep. 2014).
De Weers et al., "Daratumumab, a Novel Therapeutic Human CD38 Monoclonal Antibody, Induces Killing of Multiple Myeloma and Other Hematological Tumors", The Journal of Immunology, vol. 186, No. 3, pp. 1840-1848 (Dec. 2010).
Wang et al., Comparison of Biologic Activity of Two Anti-PSA/Anti-CD3 Bispecific Singlechain Antibodies, National Journal of Androloqy, vol. 13(1), pp. 8-12 (2007).
Wu et al., Fab-based bispecific antibody formats with robust biophysical properties and biological activity. mAbs, 7:3, 470-482, Published online: May 1, 2015.
Holliger et al., Engineered antibody fragments and the rise of single domains., Nature Biotechnology, vol. 23, pp. 1126-1136 (2005).
Reusch U et al Anti-CD3 x anti-epidermal growth factor receptor (EGFR) bispecific antibody redirects T-cell cytolytic activity to EGFRpositive cancers in vitro and in an animal model, Clinical Cancer Research, The American Association for Cancer Research, US, vol. 12, No. 1, Jan. 1, 2006 (Jan. 1, 2006), pp. 183-190.
Roland Kontermann: "Dual targeting strategies with bispecific antibodies", mAbs, vol. 4, No. 2, Mar. 1, 2012 (Mar. 1, 2012), pp. 182-197, XP055566203.
Kontermann Rolande: "Recombinant bispecific antibodies for cancer therapy", Acta Pharmacologica Sinica, vol. 26, No. 1, Jan. 1, 2005 (Jan. 1, 2005), pp. 1-9, XP002426874.
Steffen Dickopf et al, "Format and geometries matter: Structure-based design defines the functionality of bispecific antibodies", *Computational and Structural Biotechnology Journal*, vol. 18, May 14, 2020 (May 14, 2020), p. 1221-1227.
Roda-Navarro Pedro et al, "Understanding the Spatial Topology of Artificial Immunological Synapses Assembled in T Cell-Redirecting Strategies: A Major Issue in Cancer Immunotherapy", Frontiers in Cell and Developmental Biology, vol. 7, Jan. 10, 2020 (Jan. 10, 2020).
Suurs Frans V et al, "A review of bispecific antibodies and antibody constructs in oncology and clinical challenges", Apr. 24, 2019 (Apr. 24, 2019), vol. 201, p. 103-119.
Chen Shixue et al, "Immunoglobulin Gamma-Like Therapeutic Bispecific Antibody Formats for Tumor Therapy", US Feb. 11, 2019 (Feb. 11, 2019), vol. 2019, p. 1-13.
Thomas Van Blarcom et al., "Productive common light chain libraries yield diverse panels of high affinity bispecific antibodies", MABS, vol. 10, No. 2, Dec. 14, 2017 (Dec. 14, 2017), p. 256-268.
Hedvat Michael et al, "697—Tumor-targeted CD28 costimulatory bispecific antibodies enhance T cell activation in solid tumors", Journal for Immunotherapy of Cancer, vol. 8, No. Suppl 3, Nov. 1, 2020 (Nov. 1, 2020), p. A739-A739.
Correnti Colin E et al: "Simultaneous multiple interaction T-cell engaging (SMITE) bispecific antibodies overcome bispecific T-cell engager (BiTE) resistance via CD28 co-stimulation", Leukemia, Nature Publishing Group UK, London, vol. 32, No. 5, Jan. 31, 2018 (Jan. 31, 2018), pp. 1239-1243 &.
Correnti, Colin E. et al: Supplemental Methods Simultaneous multiple interaction T-cell engaging (SMITE) bispecific antibodies overcome bispecific T-cell engager (BiTE) resistance via CD28 co-stimulation, Leukemia, Jan. 31, 2018 (Jan. 31, 2018), pp. 1-7, XP055656259, DOI: 10.1038/s41375-018-0014-3 Retrieved from the Internet: URL:doi:10.1038/s41375-018-0014-[retrieved on Jan. 9, 2020].
Brinkmann et al: The making of bispecific antibodies., MABS, vol. 9, No. 2, Jan. 10, 2017 (Jan. 10, 2017), pp. 182-212.
Moore Gregory L et al: "Abstract 1880: PDL1-targeted CD28 costimulatory bispecific antibodies enhance T cell activation in solid tumors", Cancer Research, Jul. 1, 2021 (Jul. 1, 2021), XP055881520, Retrieved from the Internet: URL:https://cancerres.aacrjournals.org/content/81/13_Supplement/1880.
Tolcher Anthony W. et al: "A phase 1 study of anti-TGF[beta] receptor type-II monoclonal antibody LY3022859 in patients with advanced solid tumors", Cancer Chemotherapy and Pharmacology, Springer Verlag, Berlin, DE, vol. 79, No. 4, Mar. 9, 2017 (Mar. 9, 2017), pp. 673-680, XP036196406.
Moore Gregory et al: "714—PD1 x TGF[beta]R2 bispecifics selectively block TGF[beta]R2 on PD1-positive T cells, promote T cell activation, and elicit an anti-tumor response in solid tumors", Journal for Immunotherapy of Cancer, vol. 8, No. Suppl 3, Nov. 9, 2020 (Nov. 9, 2020), pp. A756-A756.
Brinkmann et al., Cloning and expression of the recombinant FAb fragment of monoclonal antibody K1 that reacts with mesothelin present on mesotheliomas and ovarian cancers., Int J Cancer. May 16, 1997;71(4):638-44.
Stadler et al., Elimination of large tumors in mice by mRNA-encoded bispecific antibodies., Nat Med. Jul. 2017;23(7):815-817. doi: 10.1038/nm.4356. Epub Jun. 12, 2017.

\* cited by examiner

Figure 1A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 1B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 1C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 1D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 1E

| Monomer 1 | Monomer 2 |
|---|---|
| T366S/L368A/Y407V/S354C | T366W/Y349C |
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 2

| Variant constant region | Substitutions |
|---|---|
| pI-ISO(-) | I199T/N203D/K274Q/R355Q/N384S/K392N/N397M/Q419E/K447_ |
| pI_ISO(-)-Fc only | K274Q/R355Q/N384S/K392N/V397M/Q419E/K447_ |
| pI_(-)_isosteric_A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 3

Ablation Variants
G236R
S239G
S239K
S239Q
S239R
V266D
S267K
S267R
H268K
E269R
299R
299K
K322A
A327G
A327L
A327N
A327Q
L328E
L328R
P329A
P329H
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 4

| Heavy Chain 1 (-) e.g. Fab-Fc | Heavy Chain 2 (+) e.g. scFv-Fc or Fab-scFv-Fc |
|---|---|
|  | C220S |
| Heterodimer variants L368D/K370S | Heterodimer variants S364K/E357Q |
| Isosteric pI substitutions N208D/Q295E/N384D/Q418E/N421D |  |
| FcKO E233P/L234V/L235A/G236_/S267K | FcKO E233P/L234V/L235A/G236_/S267K |
| ±M428L/N434S | ±M428L/N434S |

Figure 5

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | 1 |
| Whitlow linker | GSTSGSGKPGSGEGSTKG | 18 | +1 | 7 |
| 6paxA_1 (+A) | IRPRAIGGSKPRVA | 14 | +4 | 8 |
| +B | GKGGSGKGGSGKGGS | 15 | +3 | 9 |
| +C | GGKGSGGKGSGGKGS | 15 | +3 | 10 |
| +D | GGGKSGGGKSGGGKS | 15 | +3 | 11 |
| +E | GKGKSGKGKSGKGKS | 15 | +6 | 12 |
| +F | GGGKSGGKGSGKGGS | 15 | +3 | 13 |
| +G | GKPGSGKPGSGKPGS | 15 | +3 | 14 |
| +H | GKPGSGKPGSGKPGSGKPGS | 20 | +4 | 15 |
| +I | GKGKSGKGKSGKGKSGKGKS | 20 | +8 | 16 |

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | 17 |
| 3hsc_2 (-A) | STAGDTHLGGEDFD | 14 | -4 | 18 |
| -B | GEGGSGEGGSGEGGS | 15 | -3 | 19 |
| -C | GGEGSGGEGSGGEGS | 15 | -3 | 20 |
| -D | GGGESGGGESGGGES | 15 | -3 | 21 |
| -E | GEGESGEGESGEGES | 15 | -6 | 22 |
| -F | GGGESGGEGSGEGGS | 15 | -3 | 23 |
| -G | GEGESGEGESGEGESGEGES | 20 | -8 | 24 |

Additional scFv Linkers

| | |
|---|---|
| GGGGSGGGGSGGGGS | SEQ ID NO:25 |
| GGGGSGGGGSGGGGSGGGGS | SEQ ID NO:26 |
| GSTSGSGKPGSGEGSTKG | SEQ ID NO:27 |
| PRGASKSGSASQTGSAPGS | SEQ ID NO:28 |
| GTAAAGAGAAGGAAAGAAG | SEQ ID NO:29 |
| GTSGSSGSGSGGSGSGGG | SEQ ID NO:30 |
| GKPGSGKPGSGKPGSGKPGS | SEQ ID NO:6 |

Figure 6

Useful domain linkers

| Name | Sequence | SEQ ID NO: |
|---|---|---|
| (GGGGS)$_1$ or GGGGS | GGGGS | 5 |
| (GGGGS)$_2$ | GGGGSGGGGS | 31 |
| (GGGGS)$_3$ | GGGGSGGGGSGGGGS | 32 |
| (GGGGS)$_4$ | GGGGSGGGGSGGGGSGGGGS | 33 |
| (GGGGS)$_5$ | GGGGSGGGGSGGGGSGGGGSGGGGS | 34 |
| (GGGGS)$_6$ | GGGGSGGGGSGGGGSGGGGSGGGGSGGGGS | 35 |
| (GGGGS)$_7$ | GGGGSGGGGSGGGGSGGGGSGGGGSGGGGSGGGGS | 36 |
| (GGGGA)$_1$ or GGGGA | GGGGA | 37 |
| (GGGGA)$_2$ | GGGGAGGGGA | 38 |
| (GGGGA)$_3$ | GGGGAGGGGAGGGGA | 39 |
| (GGGGA)$_4$ | GGGGAGGGGAGGGGAGGGGA | 40 |
| (GGGGA)$_5$ | GGGGAGGGGAGGGGAGGGGAGGGGA | 41 |
| (GGGGA)$_6$ | GGGGAGGGGAGGGGAGGGGAGGGGAGGGGA | 42 |
| (GGGGA)$_7$ | GGGGAGGGGAGGGGAGGGGAGGGGAGGGGAGGGGA | 43 |
| 30AA-linker | DPALVHQRPAPPGGGGSGGGGSGGGGSGGG | 44 |
| (GKPGS)$_1$ or GKPGS | GKPGS | 45 |
| (GKPGS)$_5$ | GKPGSGKPGSGKPGSGKPGSGKPGS | 46 |
| (GKPGS)$_6$ | GKPGSGKPGSGKPGSGKPGSGKPGSGKPGS | 47 |
| (GGGES)$_1$ or GGGES | GGGES | 48 |
| "half hinge" | KTHTCPPCP | 49 |
| "full hinge C220S variant" | EPKSSDKTHTCPPCP | 50 |
| "flex half hinge" | GGGGSGGGGSKTHTCPPCP | 51 |
| "charged half hinge1" | GKPGSGKPGSKTHTCPPCP | 52 |
| "charged half hinge2" | GKPGSKTHTCPPCP | 53 |

Figure 7A

1 + 1 Fab-scFv-Fc Backbone 1

\>Fab-Fc Side (SEQ ID NO: 54)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK \>scFv-Fc Side (SEQ ID NO: 55)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

1 + 1 Fab-scFv-Fc Backbone 2

\>Fab-Fc Side (SEQ ID NO: 56)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK \>scFv-Fc Side (SEQ ID NO: 57)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK

1 + 1 Fab-scFv-Fc Backbone 3

\>Fab-Fc Side (SEQ ID NO: 58)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCEVSGFYPSDIAVEWESDGQPENNYKTTPPVLDSDGSFFLYSKLTVDKSRWEQGDVFSCS
VMHEALHNHYTQKSLSLSPGK \>scFv-Fc Side (SEQ ID NO: 59)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK

1 + 1 Fab-scFv-Fc Backbone 4

\>Fab-Fc Side (SEQ ID NO: 60)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTENEVSLTCLVKGFYPSDIAVEWESDGQPENNYKTTPPVLDSDGSFFLYSKLEVDKSRWEQGDVFSCS
VMHEALHNHYTQKSLSLSPGK

Figure 7B

>scFv-Fc Side (SEQ ID NO: 61)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSKGSFFLYSKLTVDKSRWQQGNVFSCSVMHEALHNHYTQKSLSLSPGK 1 + 1 Fab-scFv-Fc Backbone 5

>Fab-Fc Side (SEQ ID NO: 62)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSRDELTKNQVSLTCDVSGFYPSDIAVEWESDGQPENNYKTTPPVLDSDGSFFLYSKLTVDKSRWEQGDVFSCS
VMHEALHNHYTQKSLSLSPGK >scFv-Fc Side (SEQ ID NO: 63)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSRDQLTKNQVKLTCLVK
GFYPSDIAVEWESNGQPENNYKTTPPVLDSDGSFFLYSKLTVDKSRWQQGNVFSCSVMHEALHNHYTQKSLSLSPGK 1 + 1 Fab-scFv-Fc Backbone 6

>Fab-Fc Side (SEQ ID NO: 64)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYASTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK >scFv-Fc Side (SEQ ID NO: 65)
EPKSSDKTHTCPPCPAPPVAGPSVFLFPPKPKDTLMISRTPEVTCVVVDVKHEDPEVKFNWYVDGVEVHNAKTKPRE
EQYASTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK 1 + 1 Fab-scFv-Fc Backbone 7

>Fab-Fc Side (SEQ ID NO: 66)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYSSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK >scFv-Fc Side (SEQ ID NO: 67)
EPKSSDKTHTCPPCPAPPVAGPSVFLFPPKPKDTLMISRTPEVTCVVVDVKHEDPEVKFNWYVDGVEVHNAKTKPRE
EQYSSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 7C

1 + 1 Fab-scFv-Fc Backbone 8

>Fab-Fc Side (SEQ ID NO: 68)
ASTKGPSVFPLAPCSRSTSESTAALGCLVKDYFPEPVTVSWNSGALTSGVHTFPAVLQSSGLYSLSSVVTVPSSSLG
TKTYTCNVDHKPSDTKVDKRVESKYGPPCPPCPAPEFLGGPSVFLFPPKPKDTLMISRTPEVTCVVVDVSQEDPEVQ
FNWYVDGVEVHNAKTKPREEEFNSTYRVVSVLTVLHQDWLNGKEYKCKVSNKGLPSSIEKTISKAKGQPREPQVYTL
PPSQEEMTKNQVSLTCDVSGFYPSDIAVEWESDGQPENNYKTTPPVLDSDGSFFLYSRLTVDKSRWEEGDVFSCSVM
HEALHNHYTQKSLSLSLGK >scFv-Fc Side (SEQ ID NO: 69)
ESKYGPPCPPCPAPEFLGGPSVFLFPPKPKDTLMISRTPEVTCVVVDVSQEDPEVQFNWYVDGVEVHNAKTKPREEQ
FNSTYRVVSVLTVLHQDWLNGKEYKCKVSNKGLPSSIEKTISKAKGQPREPQVYTLPPSQEQMTKNQVKLTCLVKGF
YPSDIAVEWESNGQPENNYKTTPPVLDSDGSFFLYSRLTVDKSRWQEGNVFSCSVMHEALHNHYTQKSLSLSLGK

1 + 1 Fab-scFv-Fc Backbone 9

>Fab-Fc Side (SEQ ID NO: 70)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPFCPAPPVAGPSVFLFPPKPKDTLMISRTPEVTCVVVDVSHEDPEVQF
NWYVDGVEVHNAKTKPREEEFNSTFRVVSVLTVVHQDWLNGKEYKCKVSNKGLPAPIEKTISKTKGQPREPQVYTLP
PSREEMTKNQVSLTCDVSGFYPSDIAVEWESDGQPENNYKTTPPMLDSDGSFFLYSKLTVDKSRWEQGDVFSCSVMH
EALHNHYTQKSLSLSPGK >scFv-Fc Side (SEQ ID NO: 71)
ERKCCVECPPCPAPPVAGPSVFLFPPKPKDTLMISRTPEVTCVVVDVSHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK

1 + 1 Fab-scFv-Fc Backbone 10

>Fab-Fc Side (SEQ ID NO: 72)
ASTKGPSVFPLAPCSRSTSESTAALGCLVKDYFPEPVTVSWNSGALTSGVHTFPAVLQSSGLYSLSSVVTVPSSNFG
TQTYTCNVDHKPSDTKVDKTVERKCCVECPPCPAPPVAGPSVFLFPPKPKDTLMISRTPEVTCVVVDVKHEDPEVQF
NWYVDGVEVHNAKTKPREEEFNSTFRVVSVLTVVHQDWLNGKEYKCKVSNKGLPAPIEKTISKTKGQPREPQVYTLP
PSREEMTKNQVSLTCDVSGFYPSDIAVEWESDGQPENNYKTTPPMLDSDGSFFLYSKLTVDKSRWEQGDVFSCSVMH
EALHNHYTQKSLSLSPGK >scFv-Fc Side (SEQ ID NO: 73)
ERKCCVECPPCPAPPVAGPSVFLFPPKPKDTLMISRTPEVTCVVVDVKHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK

1 + 1 Fab-scFv-Fc Backbone 11

>Fab-Fc Side (SEQ ID NO: 74)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VLHEALHSHYTQKSLSLSPGK

Figure 7D

>scFv-Fc Side (SEQ ID NO: 75)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVLHEALHSHYTQKSLSLSPGK <u>1 + 1 Fab-scFv-Fc Backbone 12</u>

>Fab-Fc Side (SEQ ID NO: 76)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREEMTKNQVSLTCDVAGFYPSDIAVEWESNGQPENNYKTTPPVLDSDGSFFLYSKLTVDKSRWQQGNVFSCS
VMHEALHNHYTQKSLSLSPGK

>scFv-Fc Side (SEQ ID NO: 77)
ERKSSDKTHTCPPRPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 8A

2 + 1 Fab2-scFv-Fc Backbone 1

>Fab-Fc Side (SEQ ID NO: 78)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

>Fab-scFv-Fc Side (SEQ ID NO: 79)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

2 + 1 Fab2-scFv-Fc Backbone 2

>Fab-Fc Side (SEQ ID NO: 80)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

>Fab-scFv-Fc Side (SEQ ID NO: 81)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

2 + 1 Fab2-scFv-Fc Backbone 3

>Fab-Fc Side (SEQ ID NO: 82)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCEVSGFYPSDIAVEWESDGQPENNYKTTPPVLDSDGSFFLYSKLTVDKSRWEQGDVFSCS
VMHEALHNHYTQKSLSLSPGK

>Fab-scFv-Fc Side (SEQ ID NO: 83)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVKLTCLVKGFYPSDIAVEWESNG
QPENNYKTTPPVLDSDGSFFLYSKLTVDKSRWQQGNVFSCSVMHEALHNHYTQKSLSLSPGK

2 + 1 Fab2-scFv-Fc Backbone 4

>Fab-Fc Side (SEQ ID NO: 84)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTENEVSLTCLVKGFYPSDIAVEWESDGQPENNYKTTPPVLDSDGSFFLYSKLEVDKSRWEQGDVFSCS
VMHEALHNHYTQKSLSLSPGK

Figure 8B

>Fab-scFv-Fc Side (SEQ ID NO: 85)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSKGSFFLYSKLTVDKSRWQQGNVFSCSVMHEALHNHYTQKSLSLSPGK 2 + 1 Fab2-scFv-Fc Backbone 5

>Fab-Fc Side (SEQ ID NO: 86)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSRDELTKNQVSLTCDVSGFYPSDIAVEWESDGQPENNYKTTPPVLDSDGSFFLYSKLTVDKSRWEQGDVFSCS
VMHEALHNHYTQKSLSLSPGK

>Fab-scFv-Fc Side (SEQ ID NO: 87)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSRDQLTKNQVKLTCLVKGFYPSDIAVEWESNG
QPENNYKTTPPVLDSDGSFFLYSKLTVDKSRWQQGNVFSCSVMHEALHNHYTQKSLSLSPGK 2 + 1 Fab2-scFv-Fc Backbone 6

>Fab-Fc Side (SEQ ID NO: 88)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYASTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

>Fab-scFv-Fc Side (SEQ ID NO: 89)
APPVAGPSVFLFPPKPKDTLMISRTPEVTCVVVDVKHEDPEVKFNWYVDGVEVHNAKTKPREEQYASTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK 2 + 1 Fab2-scFv-Fc Backbone 7

>Fab-Fc Side (SEQ ID NO: 90)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYSSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VMHEALHNHYTQKSLSLSPGK

>Fab-scFv-Fc Side (SEQ ID NO: 91)
APPVAGPSVFLFPPKPKDTLMISRTPEVTCVVVDVKHEDPEVKFNWYVDGVEVHNAKTKPREEQYSSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Figure 8C

2 + 1 Fab2-scFv-Fc Backbone 8

>Fab-Fc Side (SEQ ID NO: 92)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSDTKVDKKVEPKSCDKTHTCPPCPAPPVAGPSVFLFPPKPKDTLMISRTPEVTCVVVDVKHEDPE
VKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCS
VLHEALHSHYTQKSLSLSPGK

>Fab-scFv-Fc Side (SEQ ID NO: 93)
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVLHEALHSHYTQKSLSLSPGK

2 + 1 Fab2-scFv-Fc Backbone 9

>Fab-Fc Side (SEQ ID NO: 94)
ASTKGPSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREEMTKNQVSLTCDVAGFYPSDIAVEWESNGQPENNYKTTPPVLDSDGSFFLYSKLTVDKSRWQQGNVFSCS
VMHEALHNHYTQKSLSLSPGK

>Fab-scFv-Fc Side (SEQ ID NO: 95)
APPVAGPSVFLFPPKPKDTLMISRTPEVTCVVVDVKHEDPEVKFKWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Figure 9

Constant Light Domain – Kappa (SEQ ID NO: 96)
RTVAAPSVFIFPPSDEQLKSGTASVVCLLNNFYPREAKVQWKVDNALQSGNSQESVTEQDSKDSTYSLSSTLTLSKADYEKHKVYACEVTHQG
LSSPVTKSFNRGEC

Constant Light Domain – Lambda (SEQ ID NO: 97)
GQPKAAPSVTLFPPSSEELQANKATLVCLISDFYPGAVTVAWKADSSPVKAGVETTTPSKQSNNKYAASSYLSLTPE
QWKSHRSYSCQVTHEGSTVEKTVAPTECS

Figure 10A

CD3 High – [anti-CD3]_H1.30_L1.47_scFv

| | Sequence | SEQ ID NO: |
|---|---|---|
| scFv (VHVL) | EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGDSYVSWFAY</u>WGQGTLVTVSS/<u>GKPGSGKPGSGKPGSGKPGS</u>/QAVVTQEPSLTVSPGGTVTLTC<u>GSSTGAVTTSNYAN</u>WVQQKPGKSPRGLIGG<u>TNKRAP</u>GVPARFSGSLLGGKAALTISGAQPEDEADYYC<u>ALWYSNHWV</u>FGGGTKLTVL | 98 |
| scFv (VLVH) | QAVVTQEPSLTVSPGGTVTLTC<u>GSSTGAVTTSNYAN</u>WVQQKPGKSPRGLIGG<u>TNKRAP</u>GVPARFSGSLLGGKAALTISGAQPEDEADYYC<u>ALWYSNHWV</u>FGGGTKLTVL/<u>GKPGSGKPGSGKPGSGKPGS</u>/EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGDSYVSWFAY</u>WGQGTLVTVSS | 99 |
| Variable Heavy (vh) Domain | EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGDSYVSWFAY</u>WGQGTLVTVSS | 100 |
| vhCDR1 | <u>TYAMN</u> | 101 |
| vhCDR2 | <u>RIRSKYNNYATYYADSVKG</u> | 102 |
| vhCDR3 | <u>HGNFGDSYVSWFAY</u> | 103 |
| Variable Light (vl) Domain | QAVVTQEPSLTVSPGGTVTLTC<u>GSSTGAVTTSNYAN</u>WVQQKPGKSPRGLIGG<u>TNKRAP</u>GVPARFSGSLLGGKAALTISGAQPEDEADYYC<u>ALWYSNHWV</u>FGGGTKLTVL | 104 |
| vlCDR1 | <u>GSSTGAVTTSNYAN</u> | 105 |
| vlCDR2 | <u>GTNKRAP</u> | 106 |
| vlCDR3 | <u>ALWYSNHWV</u> | 107 |
| Linker | <u>GKPGSGKPGSGKPGSGKPGS</u> | 108 |

Figure 10B

CD3 High-Int #1 – [anti-CD3]_H1.32_L1.47_scFv

|   | Sequence | SEQ ID NO: |
|---|---|---|
| scFv (VHVL) | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 109 |
| scFv (VLVH) | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL/GKPGSGKPGSGKPGSGKPGS/EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | 110 |
| Variable Heavy (vh) Domain | EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS | 111 |
| vhCDR1 | TYAMN | 112 |
| vhCDR2 | RIRSKANNYATYYADSVKG | 113 |
| vhCDR3 | HGNFGDSYVSWFAY | 114 |
| Variable Light (vl) Domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 115 |
| vlCDR1 | GSSTGAVTTSNYAN | 116 |
| vlCDR2 | GTNKRAP | 117 |
| vlCDR3 | ALWYSNHWV | 118 |
| Linker | GKPGSGKPGSGKPGSGKPGS | 119 |

Figure 10C

CD3 High-Int #2 – [anti-CD3]_H1.89_L1.47_scFv

| | Sequence | SEQ ID NO: |
|---|---|---|
| scFv (VHVL) | EVQLVESGGGLVQPGGSLRLSCAASGFTFS<u>TYAMN</u>WVRQAPGKGLEWVG<u>RIRS KYNNYATYYADSVKG</u>RFTISRDDSKNTLYLQMNSLRAEDTAVYYCVR<u>HGNFGDE YVSWFAY</u>WGQGTLVTVSS/<u>GKPGSGKPGSGKPGSGKPGS</u>/QAVVTQEPSLTVSP GGTVTLTC<u>GSSTGAVTTSNYAN</u>WVQQKPGKSPRGLIGG<u>TNKRAP</u>GVPARFSGSL LGGKAALTISGAQPEDEADYYC<u>ALWYSNHWV</u>FGGGTKLTVL | 120 |
| scFv (VLVH) | QAVVTQEPSLTVSPGGTVTLTC<u>GSSTGAVTTSNYAN</u>WVQQKPGKSPRGLIGG<u>TN KRAP</u>GVPARFSGSLLGGKAALTISGAQPEDEADYYC<u>ALWYSNHWV</u>FGGGTKLTV L/<u>GKPGSGKPGSGKPGSGKPGS</u>/EVQLVESGGGLVQPGGSLRLSCAASGFTFS<u>TY AMN</u>WVRQAPGKGLEWVG<u>RIRSKYNNYATYYADSVKG</u>RFTISRDDSKNTLYLQM NSLRAEDTAVYYCVR<u>HGNFGDEYVSWFAY</u>WGQGTLVTVSS | 121 |
| Variable Heavy (vh) Domain | EVQLVESGGGLVQPGGSLRLSCAASGFTFS<u>TYAMN</u>WVRQAPGKGLEWVG<u>RIRS KYNNYATYYADSVKG</u>RFTISRDDSKNTLYLQMNSLRAEDTAVYYCVR<u>HGNFGDE YVSWFAY</u>WGQGTLVTVSS | 122 |
| vhCDR1 | <u>TYAMN</u> | 123 |
| vhCDR2 | <u>RIRSKYNNYATYYADSVKG</u> | 124 |
| vhCDR3 | <u>HGNFGDEYVSWFAY</u> | 125 |
| Variable Light (vl) Domain | QAVVTQEPSLTVSPGGTVTLTC<u>GSSTGAVTTSNYAN</u>WVQQKPGKSPRGLIGG<u>TN KRAP</u>GVPARFSGSLLGGKAALTISGAQPEDEADYYC<u>ALWYSNHWV</u>FGGGTKLTV L | 126 |
| vlCDR1 | <u>GSSTGAVTTSNYAN</u> | 127 |
| vlCDR2 | <u>GTNKRAP</u> | 128 |
| vlCDR3 | <u>ALWYSNHWV</u> | 129 |
| Linker | <u>GKPGSGKPGSGKPGSGKPGS</u> | 130 |

Figure 10D

CD3 High-Int #3 – [anti-CD3]_H1.90_L1.47_scFv

|  | Sequence | SEQ ID NO: |
|---|---|---|
| scFv (VHVL) | EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGDPYVSWFAY</u>WGQGTLVTVSS/<u>GKPGSGKPGSGKPGSGKPGS</u>/QAVVTQEPSLTVSPGGTVTLTC<u>GSSTGAVTTSNYAN</u>WVQQKPGKSPRGLIG<u>GTNKRAP</u>GVPARFSGSLLGGKAALTISGAQPEDEADYYC<u>ALWYSNHWV</u>FGGGTKLTVL | 131 |
| scFv (VLVH) | QAVVTQEPSLTVSPGGTVTLTC<u>GSSTGAVTTSNYAN</u>WVQQKPGKSPRGLIG<u>GTNKRAP</u>GVPARFSGSLLGGKAALTISGAQPEDEADYYC<u>ALWYSNHWV</u>FGGGTKLTVL/<u>GKPGSGKPGSGKPGSGKPGS</u>/EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGDPYVSWFAY</u>WGQGTLVTVSS | 132 |
| Variable Heavy (vh) Domain | EVQLVESGGGLVQPGGSLRLSCAASGFTFS<u>TYAMN</u>WVRQAPGKGLEWVG<u>RIRSKYNNYATYYADSVKG</u>RFTISRDDSKNTLYLQMNSLRAEDTAVYYCVR<u>HGNFGDPYVSWFAY</u>WGQGTLVTVSS | 133 |
| vhCDR1 | <u>TYAMN</u> | 134 |
| vhCDR2 | <u>RIRSKYNNYATYYADSVKG</u> | 135 |
| vhCDR3 | <u>HGNFGDPYVSWFAY</u> | 136 |
| Variable Light (vl) Domain | QAVVTQEPSLTVSPGGTVTLTC<u>GSSTGAVTTSNYAN</u>WVQQKPGKSPRGLIG<u>GTNKRAP</u>GVPARFSGSLLGGKAALTISGAQPEDEADYYC<u>ALWYSNHWV</u>FGGGTKLTVL | 137 |
| vlCDR1 | <u>GSSTGAVTTSNYAN</u> | 138 |
| vlCDR2 | <u>GTNKRAP</u> | 139 |
| vlCDR3 | <u>ALWYSNHWV</u> | 140 |
| Linker | <u>GKPGSGKPGSGKPGSGKPGS</u> | 141 |

Figure 10E

CD3-Intermediate – [anti-CD3]_H1.33_L1.47_scFv

| | Sequence | SEQ ID NO: |
|---|---|---|
| scFv (VHVL) | EVQLVESGGGLVQPGGSLRLSCAASGFTFS<u>TYAMN</u>WVRQAPGKGLEWVG<u>RIRS KYNNYATYYADSVKG</u>RFTISRDDSKNTLYLQMNSLRAEDTAVYYCVR<u>HGNFGDSY VSWFDY</u>WGQGTLVTVSS/<u>GKPGSGKPGSGKPGSGKPGS</u>/QAVVTQEPSLTVSPG GTVTLTC<u>GSSTGAVTTSNYAN</u>WVQQKPGKSPRGLIGG<u>TNKRAP</u>GVPARFSGSLL GGKAALTISGAQPEDEADYYC<u>ALWYSNHWV</u>FGGGTKLTVL | 142 |
| scFv (VLVH) | QAVVTQEPSLTVSPGGTVTLTC<u>GSSTGAVTTSNYAN</u>WVQQKPGKSPRGLIGG<u>TN KRAP</u>GVPARFSGSLLGGKAALTISGAQPEDEADYYC<u>ALWYSNHWV</u>FGGGTKLTV L/<u>GKPGSGKPGSGKPGSGKPGS</u>/EVQLVESGGGLVQPGGSLRLSCAASGFTFS<u>TY AMN</u>WVRQAPGKGLEWVG<u>RIRSKYNNYATYYADSVKG</u>RFTISRDDSKNTLYLQM NSLRAEDTAVYYCVR<u>HGNFGDSYVSWFDY</u>WGQGTLVTVSS | 143 |
| Variable Heavy (vh) Domain | EVQLVESGGGLVQPGGSLRLSCAASGFTFS<u>TYAMN</u>WVRQAPGKGLEWVG<u>RIRS KYNNYATYYADSVKG</u>RFTISRDDSKNTLYLQMNSLRAEDTAVYYCVR<u>HGNFGDSY VSWFDY</u>WGQGTLVTVSS | 144 |
| vhCDR1 | <u>TYAMN</u> | 145 |
| vhCDR2 | <u>RIRSKYNNYATYYADSVKG</u> | 146 |
| vhCDR3 | <u>HGNFGDSYVSWFDY</u> | 147 |
| Variable Light (vl) Domain | QAVVTQEPSLTVSPGGTVTLTC<u>GSSTGAVTTSNYAN</u>WVQQKPGKSPRGLIGG<u>TN KRAP</u>GVPARFSGSLLGGKAALTISGAQPEDEADYYC<u>ALWYSNHWV</u>FGGGTKLTV L | 148 |
| vlCDR1 | <u>GSSTGAVTTSNYAN</u> | 149 |
| vlCDR2 | <u>GTNKRAP</u> | 150 |
| vlCDR3 | <u>ALWYSNHWV</u> | 151 |
| Linker | <u>GKPGSGKPGSGKPGSGKPGS</u> | 152 |

Figure 10F

CD3 Low – [anti-CD3]_H1.31_L1.47_scFv

|  | Sequence | SEQ ID NO: |
|---|---|---|
| scFv (VHVL) | EVQLVESGGGLVQPGGSLRLSCAASGFTFS<u>TYAMS</u>WVRQAPGKGLEWVG<u>RIRSK YNNYATYYADSVKG</u>RFTISRDDSKNTLYLQMNSLRAEDTAVYYCVR<u>HGNFGDSY VSWFAY</u>WGQGTLVTVSS/<u>GKPGSGKPGSGKPGSGKPGS</u>/QAVVTQEPSLTVSPG GTVTLTC<u>GSSTGAVTTSNYAN</u>WVQQKPGKSPRGLIG<u>GTNKRAP</u>GVPARFSGSLL GGKAALTISGAQPEDEADYYC<u>ALWYSNHWV</u>FGGGTKLTVL | 153 |
| scFv (VLVH) | QAVVTQEPSLTVSPGGTVTLTC<u>GSSTGAVTTSNYAN</u>WVQQKPGKSPRGLIG<u>GTN KRAP</u>GVPARFSGSLLGGKAALTISGAQPEDEADYYC<u>ALWYSNHWV</u>FGGGTKLTV L/<u>GKPGSGKPGSGKPGSGKPGS</u>/EVQLVESGGGLVQPGGSLRLSCAASGTFS<u>TY AMS</u>WVRQAPGKGLEWVG<u>RIRSKYNNYATYYADSVKG</u>RFTISRDDSKNTLYLQM NSLRAEDTAVYYCVR<u>HGNFGDSYVSWFAY</u>WGQGTLVTVSS | 154 |
| Variable Heavy (vh) Domain | EVQLVESGGGLVQPGGSLRLSCAASGFTFS<u>TYAMS</u>WVRQAPGKGLEWVG<u>RIRSK YNNYATYYADSVKG</u>RFTISRDDSKNTLYLQMNSLRAEDTAVYYCVR<u>HGNFGDSY VSWFAY</u>WGQGTLVTVSS | 155 |
| vhCDR1 | <u>TYAMS</u> | 156 |
| vhCDR2 | <u>RIRSKYNNYATYYADSVKG</u> | 157 |
| vhCDR3 | <u>HGNFGDSYVSWFAY</u> | 158 |
| Variable Light (vl) Domain | QAVVTQEPSLTVSPGGTVTLTC<u>GSSTGAVTTSNYAN</u>WVQQKPGKSPRGLIG<u>GTN KRAP</u>GVPARFSGSLLGGKAALTISGAQPEDEADYYC<u>ALWYSNHWV</u>FGGGTKLTV L | 159 |
| vlCDR1 | <u>GSSTGAVTTSNYAN</u> | 160 |
| vlCDR2 | <u>GTNKRAP</u> | 161 |
| vlCDR3 | <u>ALWYSNHWV</u> | 162 |
| Linker | <u>GKPGSGKPGSGKPGSGKPGS</u> | 163 |

Figure 11A

Human GPC3 sequence
>sp|P51654
MAGTVRTACLVVAMLLSLDFPGQAQPPPPPPDATCHQVRSFFQRLQPGLKWVPETPVPGSDLQVCLPKGPTCCSRKM
EEKYQLTARLNMEQLLQSASMELKFLIIQNAAVFQEAFEIVVRHAKNYTNAMFKNNYPSLTPQAFEFVGEFFTDVSL
YILGSDINVDDMVNELFDSLFPVIYTQLMNPGLPDSALDINECLRGARRDLKVFGNFPKLIMTQVSKSLQVTRIFLQ
ALNLGIEVINTTDHLKFSKDCGRMLTRMWYCSYCQGLMMVKPCGGYCNVVMQGCMAGVVEIDKYWREYILSLEELVN
GMYRIYDMENVLLGLFSTIHDSIQYVQKNAGKLTTTIGKLCAHSQQRQYR/SAYYPEDLFIDKKVLKVAHVEHEETL
SSRRRELIQKLKSFISFYSALPGYICSHSPVAENDTLCWNGQELVERYSQKAARNGMKNQFNLHELKMKGPEPVVSQ
IIDKLKHINQLLRTMSMPKGRVLDKNLDEEGFESGDCGDDEDECIGGSGDGMIKVKNQLRFLAELAYDLDVDDAPGN
SQQATPKDNEISTFHNLGNVHSPLKLLTSMAISVVCFFFLVH (SEQ ID NO: 164)

Human GPC3 sequence, alpha subunit
>sp|P51654|25-358
QPPPPPPDATCHQVRSFFQRLQPGLKWVPETPVPGSDLQVCLPKGPTCCSRKMEEKYQLTARLNMEQLLQSASMELK
FLIIQNAAVFQEAFEIVVRHAKNYTNAMFKNNYPSLTPQAFEFVGEFFTDVSLYILGSDINVDDMVNELFDSLFPVI
YTQLMNPGLPDSALDINECLRGARRDLKVFGNFPKLIMTQVSKSLQVTRIFLQALNLGIEVINTTDHLKFSKDCGRM
LTRMWYCSYCQGLMMVKPCGGYCNVVMQGCMAGVVEIDKYWREYILSLEELVNGMYRIYDMENVLLGLFSTIHDSIQ
YVQKNAGKLTTTIGKLCAHSQQRQYR (SEQ ID NO: 165)

Human GPC3 sequence, beta subunit
>sp|P51654|359-554
SAYYPEDLFIDKKVLKVAHVEHEETLSSRRRELIQKLKSFISFYSALPGYICSHSPVAENDTLCWNGQELVERYSQK
AARNGMKNQFNLHELKMKGPEPVVSQIIDKLKHINQLLRTMSMPKGRVLDKNLDEEGFESGDCGDDEDECIGGSGDG
MIKVKNQLRFLAELAYDLDVDDAPGNSQQATPKDNEISTFHN (SEQ ID NO: 166)

Macaca fascicularis GPC3 sequence
>tr|A0A2K5VK50
MAGTVRTACLVVAMLLSLDFPGQAQPPPPPPDATCHQVRSFFQRLQPGLKWVPETPVPGSDLQVCLPKGPTCCSRKM
EEKYQLTARLNMEQLLQSASMELKFLIIQNAAVFQEAFEIVVRHAKNYTNAMFKNNYPSLTPQAFEFVGEFFTDVSL
YILGSDINVDDMVNELFDSLFPVIYTQLMNPGLPDSALDINECLRGARRDLKVFGNFPKLIMTQVSKSLQVTRIFLQ
ALNLGIEVINTTDHLKFSKDCGRMLTRMWYCSYCQGLMMVKPCGGYCNVVMQGCMAGVVEIDKYWREYILSLEELVN
GMYRIYDMENVLLGLFSTIHDSIQYVQKNAGKLTTTIGKLCAHSQQRQYRSAYYPEDLFIDKKVLKVAHVEHEETLS
SRRRELIQKLKSFISFYSALPGYICSHSPVAENDTLCWNGQELVERYSQKAARNGMKNQFNLHELKMKGPEPVVSQI
IDKLKHINQLLRTMSVPKGRVLDKNLDEEGFESGDCGDDEDECIGGSGDGMMKVKNQLRFLAELAYDLDVDDVPGNN
QQATPKDNEISTFHNLGNVHSPLKLLTSMAISVVCFFFLVH (SEQ ID NO: 167)

Macaca fascicularis GPC3 sequence, alpha subunit (predicted)
>tr|A0A2K5VK50|25-358
QPPPPPPDATCHQVRSFFQRLQPGLKWVPETPVPGSDLQVCLPKGPTCCSRKMEEKYQLTARLNMEQLLQSASMELK
FLIIQNAAVFQEAFEIVVRHAKNYTNAMFKNNYPSLTPQAFEFVGEFFTDVSLYILGSDINVDDMVNELFDSLFPVI
YTQLMNPGLPDSALDINECLRGARRDLKVFGNFPKLIMTQVSKSLQVTRIFLQALNLGIEVINTTDHLKFSKDCGRM
LTRMWYCSYCQGLMMVKPCGGYCNVVMQGCMAGVVEIDKYWREYILSLEELVNGMYRIYDMENVLLGLFSTIHDSIQ
YVQKNAGKLTTTIGKLCAHSQQRQYR (SEQ ID NO: 168)

Macaca fascicularis GPC3 sequence, beta subunit (predicted)
>tr|A0A2K5VK50|359-554
SAYYPEDLFIDKKVLKVAHVEHEETLSSRRRELIQKLKSFISFYSALPGYICSHSPVAENDTLCWNGQELVERYSQK
AARNGMKNQFNLHELKMKGPEPVVSQIIDKLKHINQLLRTMSVPKGRVLDKNLDEEGFESGDCGDDEDECIGGSGDG
MMKVKNQLRFLAELAYDLDVDDVPGNNQQATPKDNEISTFHN (SEQ ID NO: 169)

Figure 11B

Mouse GPC3 sequence
>sp|Q8CFZ4
MAGTVRTACLLVAMLLGLGCLGQAQPPPPPDATCHQVRSFFQRLQPGLKWVPETPVPGSDLQVCLPKGPTCCSRKME
EKYQLTARLNMEQLLQSASMELKFLIIQNAAVFQEAFEIVVRHAKNYTNAMFKNNYPSLTPQAFEFVGEFFTDVSLY
ILGSDINVDDMVNELFDSLFPVIYTQMMNPGLPESVLDINECLRGARRDLKVFGSFPKLIMTQVSKSLQVTRIFLQA
LNLGIEVINTTDHLKFSKDCGRMLTRMWYCSYCQGLMMVKPCGGYCNVVMQGCMAGVVEIDKYWREYILSLEELVNG
MYRIYDMENVLLGLFSTIHDSIQYVQKNGGKLTTTIGKLCAHSQQRQYRSAYYPEDLFIDKKILKVAHVEHEETLSS
RRRELIQKLKSFINFYSALPGYICSHSPVAENDTLCWNGQELVERYSQKAARNGMKNQFNLHELKMKGPEPVVSQII
DKLKHINQLLRTMSVPKGKVLDKSLDEEGLESGDCGDDEDECIGSSGDGMVKVKNQLRFLAELAYDLDVDDAPGNKQ
HGNQKDNEITTSHSVGNMPSPLKILISVAIYVACFFFLVH (SEQ ID NO: 170)

Mouse GPC3 sequence, alpha subunit
>sp|Q8CFZ4|25-357
QPPPPPDATCHQVRSFFQRLQPGLKWVPETPVPGSDLQVCLPKGPTCCSRKMEEKYQLTARLNMEQLLQSASMELKF
LIIQNAAVFQEAFEIVVRHAKNYTNAMFKNNYPSLTPQAFEFVGEFFTDVSLYILGSDINVDDMVNELFDSLFPVIY
TQMMNPGLPESVLDINECLRGARRDLKVFGSFPKLIMTQVSKSLQVTRIFLQALNLGIEVINTTDHLKFSKDCGRML
TRMWYCSYCQGLMMVKPCGGYCNVVMQGCMAGVVEIDKYWREYILSLEELVNGMYRIYDMENVLLGLFSTIHDSIQY
VQKNGGKLTTTIGKLCAHSQQRQYR (SEQ ID NO: 171)

Mouse GPC3 sequence, beta subunit
>sp|Q8CFZ4|358-553
SAYYPEDLFIDKKILKVAHVEHEETLSSRRRELIQKLKSFINFYSALPGYICSHSPVAENDTLCWNGQELVERYSQK
AARNGMKNQFNLHELKMKGPEPVVSQIIDKLKHINQLLRTMSVPKGKVLDKSLDEEGLESGDCGDDEDECIGSSGDG
MVKVKNQLRFLAELAYDLDVDDAPGNKQHGNQKDNEITTSHS (SEQ ID NO: 172)

Figure 12

GPC3-A[GPC3] H1

| | sequence | SEQ ID NO: |
|---|---|---|
| Variable heavy (vh) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 173 |
| vhCDR1 | DYEMH | 174 |
| vhCDR2 | ALDPKTGDTAYSQKFQG | 175 |
| vhCDR3 | FYSYTY | 176 |

GPC3-A[GPC3] L1

| | sequence | SEQ ID NO: |
|---|---|---|
| Variable light (vl) domain | DVVMTQSPLSLPVTLGQPASISCRSSQSLVHSNGNTYLHWYQQRPGQ SPRLLIYKVSNRFSGVPDRFSGSGSGTDFTLKISRVEAEDVGVYFCS QNTHVPPTFGSGTKLEIK | 177 |
| vlCDR1 | RSSQSLVHSNGNTYLH | 178 |
| vlCDR2 | KVSNRFS | 179 |
| vlCDR3 | SQNTHVPPT | 180 |

Figure 13A

GPC3-A[GPC3]_H1.1

|  | sequence | SEQ ID NO: |
|---|---|---|
| Variable heavy (vh) domain | QVQLVQSGAEVKKPGASVKVSCKASGYTFTDYEMHWVRQAPGQGLEW MGALEPKTGDTAYSQKFQGRVTMTADKSISTAYMELSRLRSDDTAVY YCTRFYSYTYWGQGTLVTVSS | 181 |
| vhCDR1 | DYEMH | 182 |
| vhCDR2 | ALEPKTGDTAYSQKFQG | 183 |
| vhCDR3 | FYSYTY | 184 |

GPC3-A[GPC3]_H1.2

|  | sequence | SEQ ID NO: |
|---|---|---|
| Variable heavy (vh) domain | QVQLVQSGAEVKKPGASVKVSCKASGYTFTDYEMHWVRQAPGQGLEW MGALNPKTGDTAYSQKFQGRVTMTADKSISTAYMELSRLRSDDTAVY YCTRFYSYTYWGQGTLVTVSS | 185 |
| vhCDR1 | DYEMH | 186 |
| vhCDR2 | ALNPKTGDTAYSQKFQG | 187 |
| vhCDR3 | FYSYTY | 188 |

GPC3-A[GPC3]_H1.3

|  | sequence | SEQ ID NO: |
|---|---|---|
| Variable heavy (vh) domain | QVQLVQSGAEVKKPGASVKVSCKASGYTFTDYEMHWVRQAPGQGLEW MGALQPKTGDTAYSQKFQGRVTMTADKSISTAYMELSRLRSDDTAVY YCTRFYSYTYWGQGTLVTVSS | 189 |
| vhCDR1 | DYEMH | 190 |
| vhCDR2 | ALQPKTGDTAYSQKFQG | 191 |
| vhCDR3 | FYSYTY | 192 |

GPC3-A[GPC3]_H1.4

|  | sequence | SEQ ID NO: |
|---|---|---|
| Variable heavy (vh) domain | QVQLVQSGAEVKKPGASVKVSCKASGYTFTDYEMHWVRQAPGQGLEW MGALSPKTGDTAYSQKFQGRVTMTADKSISTAYMELSRLRSDDTAVY YCTRFYSYTYWGQGTLVTVSS | 193 |
| vhCDR1 | DYEMH | 194 |
| vhCDR2 | ALSPKTGDTAYSQKFQG | 195 |
| vhCDR3 | FYSYTY | 196 |

Figure 13B

GPC3-A[GPC3]_L1.1

|  | sequence | SEQ ID NO: |
|---|---|---|
| Variable light (vl) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 197 |
| vlCDR1 | DYEMH | 198 |
| vlCDR2 | ALDPKTGDTAYSQKFQG | 199 |
| vlCDR3 | FYSYTY | 200 |

GPC3-A[GPC3]_L1.2

|  | sequence | SEQ ID NO: |
|---|---|---|
| Variable light (vl) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 201 |
| vlCDR1 | DYEMH | 202 |
| vlCDR2 | ALDPKTGDTAYSQKFQG | 203 |
| vlCDR3 | FYSYTY | 204 |

GPC3-A[GPC3]_L1.3

|  | sequence | SEQ ID NO: |
|---|---|---|
| Variable light (vl) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 205 |
| vlCDR1 | DYEMH | 206 |
| vlCDR2 | ALDPKTGDTAYSQKFQG | 207 |
| vlCDR3 | FYSYTY | 208 |

GPC3-A[GPC3]_L1.4

|  | sequence | SEQ ID NO: |
|---|---|---|
| Variable light (vl) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 209 |
| vlCDR1 | DYEMH | 210 |
| vlCDR2 | ALDPKTGDTAYSQKFQG | 211 |
| vlCDR3 | FYSYTY | 212 |

Figure 13C

GPC3-A[GPC3] L1.5

|  | sequence | SEQ ID NO: |
|---|---|---|
| Variable light (vl) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 213 |
| vlCDR1 | DYEMH | 214 |
| vlCDR2 | ALDPKTGDTAYSQKFQG | 215 |
| vlCDR3 | FYSYTY | 216 |

GPC3-A[GPC3] L1.6

|  | sequence | SEQ ID NO: |
|---|---|---|
| Variable light (vl) domain | DVVMTQSPLSLPVTLGQPASISCRSSQSLVHSNTNTYLHWYQQRPGQ SPRLLIYKVSNRFSGVPDRFSGSGSGTDFTLKISRVEAEDVGVYFCS QNTHVPPTFGSGTKLEIK | 217 |
| vlCDR1 | RSSQSLVHSNTNTYLH | 218 |
| vlCDR2 | KVSNRFS | 219 |
| vlCDR3 | SQNTHVPPT | 220 |

GPC3-A[GPC3] L1.7

|  | sequence | SEQ ID NO: |
|---|---|---|
| Variable light (vl) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 221 |
| vlCDR1 | DYEMH | 222 |
| vlCDR2 | ALDPKTGDTAYSQKFQG | 223 |
| vlCDR3 | FYSYTY | 224 |

GPC3-A[GPC3] L1.8

|  | sequence | SEQ ID NO: |
|---|---|---|
| Variable light (vl) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 225 |
| vlCDR1 | DYEMH | 226 |
| vlCDR2 | ALDPKTGDTAYSQKFQG | 227 |
| vlCDR3 | FYSYTY | 228 |

Figure 13D

GPC3-A[GPC3] L1.9

|  | sequence | SEQ ID NO: |
|---|---|---|
| Variable light (vl) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 229 |
| vlCDR1 | DYEMH | 230 |
| vlCDR2 | ALDPKTGDTAYSQKFQG | 231 |
| vlCDR3 | FYSYTY | 232 |

GPC3-A[GPC3] L1.10

|  | sequence | SEQ ID NO: |
|---|---|---|
| Variable light (vl) domain | QVQLVQSGAEVKKPGASVKVSCKASGYTFTDYEMHWVRQAPGQGLEW MGALDPKTGDTAYSQKFQGRVTMTADKSISTAYMELSRLRSDDTAVY YCTRFYSYTYWGQGTLVTVSS | 233 |
| vlCDR1 | DYEMH | 234 |
| vlCDR2 | ALDPKTGDTAYSQKFQG | 235 |
| vlCDR3 | FYSYTY | 236 |

GPC3-A[GPC3] L1.16

|  | sequence | SEQ ID NO: |
|---|---|---|
| Variable light (vl) domain | DVVMTQSPLSLPVTLGQPASISCRSSQSLVHSSGNTYLHWYQQRPGQ SPRLLIYKVSNRFSGVPDRFSGSGSGTDFTLKISRVEAEDVGVYFCS QSTHVPPTFGSGTKLEIK | 237 |
| vlCDR1 | RSSQSLVHSSGNTYLH | 238 |
| vlCDR2 | KVSNRFS | 239 |
| vlCDR3 | SQSTHVPPT | 240 |

GPC3-A[GPC3] L1.23

|  | sequence | SEQ ID NO: |
|---|---|---|
| Variable light (vl) domain | DVVMTQSPLSLPVTLGQPASISCRSSQSLVHSNGNTWLHWYQQRPGQ SPRLLIYKVSNRFSGVPDRFSGSGSGTDFTLKISRVEAEDVGVYFCS QNTHVPPTFGSGTKLEIK | 241 |
| vlCDR1 | RSSQSLVHSNGNTWLH | 242 |
| vlCDR2 | KVSNRFS | 243 |
| vlCDR3 | SQNTHVPPT | 244 |

Figure 13E

GPC3-A[GPC3]_L1.29

|  | sequence | SEQ ID NO: |
|---|---|---|
| Variable light (vl) domain | DVVMTQSPLSLPVTLGQPASISCRSSQSLVHSNGNTYLHWYQQRPGQSPRLLIYQVSNRFSGVPDRFSGSGSGTDFTLKISRVEAEDVGVYFCSQNTHVPPTFGSGTKLEIK | 245 |
| vlCDR1 | RSSQSLVHSNGNTYLH | 246 |
| vlCDR2 | QVSNRFS | 247 |
| vlCDR3 | SQNTHVPPT | 248 |

GPC3-A[GPC3]_L1.31

|  | sequence | SEQ ID NO: |
|---|---|---|
| Variable light (vl) domain | DVVMTQSPLSLPVTLGQPASISCRSSQSLVHSNGNTYLHWYQQRPGQSPRLLIYYVSNRFSGVPDRFSGSGSGTDFTLKISRVEAEDVGVYFCSQNTHVPPTFGSGTKLEIK | 249 |
| vlCDR1 | RSSQSLVHSNGNTYLH | 250 |
| vlCDR2 | YVSNRFS | 251 |
| vlCDR3 | SQNTHVPPT | 252 |

GPC3-A[GPC3]_L1.65

|  | sequence | SEQ ID NO: |
|---|---|---|
| Variable light (vl) domain | DVVMTQSPLSLPVTLGQPASISCRSSQSLVHSYGNTWLHWYQQRPGQSPRLLIYKVSNRFSGVPDRFSGSGSGTDFTLKISRVEAEDVGVYFCSQNTHVPPTFGSGTKLEIK | 253 |
| vlCDR1 | RSSQSLVHSYGNTWLH | 254 |
| vlCDR2 | KVSNRFS | 255 |
| vlCDR3 | SQNTHVPPT | 256 |

GPC3-A[GPC3]_L1.66

|  | sequence | SEQ ID NO: |
|---|---|---|
| Variable light (vl) domain | DVVMTQSPLSLPVTLGQPASISCRSSQSLVHSNANTWLHWYQQRPGQSPRLLIYKVSNRFSGVPDRFSGSGSGTDFTLKISRVEAEDVGVYFCSQNTHVPPTFGSGTKLEIK | 257 |
| vlCDR1 | RSSQSLVHSNANTWLH | 258 |
| vlCDR2 | KVSNRFS | 259 |
| vlCDR3 | SQNTHVPPT | 260 |

Figure 13F

GPC3-A[GPC3] L1.67

|  | sequence | SEQ ID NO: |
|---|---|---|
| Variable light (vl) domain | DVVMTQSPLSLPVTLGQPASISCRSSQSLVHSNKNTWLHWYQQRPGQ SPRLLIYKVSNRFSGVPDRFSGSGSGTDFTLKISRVEAEDVGVYFCS QNTHVPPTFGSGTKLEIK | 261 |
| vlCDR1 | RSSQSLVHSNKNTWLH | 262 |
| vlCDR2 | KVSNRFS | 263 |
| vlCDR3 | SQNTHVPPT | 264 |

GPC3-A[GPC3] L1.68

|  | sequence | SEQ ID NO: |
|---|---|---|
| Variable light (vl) domain | DVVMTQSPLSLPVTLGQPASISCRSSQSLVHSYGNTYLHWYQQRPGQ SPRLLIYQVSNRFSGVPDRFSGSGSGTDFTLKISRVEAEDVGVYFCS QNTHVPPTFGSGTKLEIK | 265 |
| vlCDR1 | RSSQSLVHSYGNTYLH | 266 |
| vlCDR2 | QVSNRFS | 267 |
| vlCDR3 | SQNTHVPPT | 268 |

GPC3-A[GPC3] L1.69

|  | sequence | SEQ ID NO: |
|---|---|---|
| Variable light (vl) domain | DVVMTQSPLSLPVTLGQPASISCRSSQSLVHSNANTYLHWYQQRPGQ SPRLLIYQVSNRFSGVPDRFSGSGSGTDFTLKISRVEAEDVGVYFCS QNTHVPPTFGSGTKLEIK | 269 |
| vlCDR1 | RSSQSLVHSNANTYLH | 270 |
| vlCDR2 | QVSNRFS | 271 |
| vlCDR3 | SQNTHVPPT | 272 |

GPC3-A[GPC3] L1.70

|  | sequence | SEQ ID NO: |
|---|---|---|
| Variable light (vl) domain | DVVMTQSPLSLPVTLGQPASISCRSSQSLVHSNKNTYLHWYQQRPGQ SPRLLIYQVSNRFSGVPDRFSGSGSGTDFTLKISRVEAEDVGVYFCS QNTHVPPTFGSGTKLEIK | 273 |
| vlCDR1 | RSSQSLVHSNKNTYLH | 274 |
| vlCDR2 | QVSNRFS | 275 |
| vlCDR3 | SQNTHVPPT | 276 |

Figure 13G

GPC3-A[GPC3]_L1.71

|  | sequence | SEQ ID NO: |
|---|---|---|
| Variable light (vl) domain | DVVMTQSPLSLPVTLGQPASISCRSSQSLVHSYGNTYLHWYQQRPGQSPRLLIYYVSNRFSGVPDRFSGSGSGTDFTLKISRVEAEDVGVYFCSQNTHVPPTFGSGTKLEIK | 277 |
| vlCDR1 | RSSQSLVHSYGNTYLH | 278 |
| vlCDR2 | YVSNRFS | 279 |
| vlCDR3 | SQNTHVPPT | 280 |

GPC3-A[GPC3]_L1.72

|  | sequence | SEQ ID NO: |
|---|---|---|
| Variable light (vl) domain | DVVMTQSPLSLPVTLGQPASISCRSSQSLVHSNANTYLHWYQQRPGQSPRLLIYYVSNRFSGVPDRFSGSGSGTDFTLKISRVEAEDVGVYFCSQNTHVPPTFGSGTKLEIK | 281 |
| vlCDR1 | RSSQSLVHSNANTYLH | 282 |
| vlCDR2 | YVSNRFS | 283 |
| vlCDR3 | SQNTHVPPT | 284 |

GPC3-A[GPC3]_L1.73

|  | sequence | SEQ ID NO: |
|---|---|---|
| Variable light (vl) domain | DVVMTQSPLSLPVTLGQPASISCRSSQSLVHSNKNTYLHWYQQRPGQSPRLLIYYVSNRFSGVPDRFSGSGSGTDFTLKISRVEAEDVGVYFCSQNTHVPPTFGSGTKLEIK | 285 |
| vlCDR1 | RSSQSLVHSNKNTYLH | 286 |
| vlCDR2 | YVSNRFS | 287 |
| vlCDR3 | SQNTHVPPT | 288 |

Figure 14A

>XENP21969_GPC3-A_H1L1_[GPC3]_IgG1_PVA_/S267K
Chain 1-GPC3-A_H1_[GPC3]_IgG1_PVA_/S267K Heavy Chain
QVQLVQSGAEVKKPGASVKVSCKASGYTFT<u>DYEMH</u>WVRQAPGQGLEWMG<u>ALDPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 289)

Chain 2-GPC3-A[GPC3]_L1 Light Chain
DVVMTQSPLSLPVTLGQPASISC<u>RSSQSLVHSNGNTYLH</u>WYQQRPGQSPRLLIY<u>KVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 290)

>XENP23060_GPC3-A_[GPC3]_H1.1_L1_IgG1_PVA_/S267K
Chain 1-GPC3-A_[GPC3]_H1.1_IgG1_PVA_/S267K Heavy Chain
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 291)
Chain 2-GPC3-A_[GPC3]_L1 Light Chain
DVVMTQSPLSLPVTLGQPASISC<u>RSSQSLVHSNGNTYLH</u>WYQQRPGQSPRLLIY<u>KVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 292)

>XENP23061_GPC3-A_[GPC3]_H1.2_L1_IgG1_PVA_/S267K
Chain 1-GPC3-A_[GPC3]_H1.2_IgG1_PVA_/S267K Heavy Chain
QVQLVQSGAEVKKPGASVKVSCKASGYTFT<u>DYEMH</u>WVRQAPGQGLEWMG<u>ALNPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 293)
Chain 2-GPC3-A_[GPC3]_L1 Light Chain
DVVMTQSPLSLPVTLGQPASISC<u>RSSQSLVHSNGNTYLH</u>WYQQRPGQSPRLLIY<u>KVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 294)

>XENP23062_GPC3-A_[GPC3]_H1.3_L1_IgG1_PVA_/S267K
Chain 1-GPC3-A_[GPC3]_H1.3_IgG1_PVA_/S267K Heavy Chain
QVQLVQSGAEVKKPGASVKVSCKASGYTFT<u>DYEMH</u>WVRQAPGQGLEWMG<u>ALQPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 295)

Figure 14B

Chain 2-GPC3-A_[GPC3]_L1 Light Chain
DVVMTQSPLSLPVTLGQPASISCRSSQSLVHSNGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 296)

>XENP23063_GPC3-A_[GPC3]_H1.4_L1_IgG1_PVA_/S267K
Chain 1-GPC3-A_[GPC3]_H1.4_IgG1_PVA_/S267K Heavy Chain
QVQLVQSGAEVKKPGASVKVSCKASGYTFTDYEMHWVRQAPGQGLEWMGALSPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 297)
Chain 2-GPC3-A_[GPC3]_L1 Light Chain
DVVMTQSPLSLPVTLGQPASISCRSSQSLVHSNGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 298)

>XENP23064_GPC3-A_[GPC3]_H1_L1.1_IgG1_PVA_/S267K
Chain 1-GPC3-A_[GPC3]_H1_IgG1_PVA_/S267K Heavy Chain
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 299)
Chain 2-GPC3-A_[GPC3]_L1.1 Light Chain
DVVMTQSPLSLPVTLGQPASISCRSSQSLVHSQGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 300)

>XENP23065_GPC3-A_[GPC3]_H1_L1.2_IgG1_PVA_/S267K
Chain 1-GPC3-A_[GPC3]_H1_IgG1_PVA_/S267K Heavy Chain
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 301)
Chain 2-GPC3-A_[GPC3]_L1.2 Light Chain
DVVMTQSPLSLPVTLGQPASISCRSSQSLVHSYGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 302)

Figure 14C

>XENP23066_GPC3-A_[GPC3]_H1_L1.3_IgG1_PVA_/S267K
Chain 1-GPC3-A_[GPC3]_H1_IgG1_PVA_/S267K Heavy Chain
QVQLVQSGAEVKKPGASVKVSCKASGYTFT<u>DYEMH</u>WVRQAPGQGLEWMG<u>ALDPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 303)
Chain 2-GPC3-A_[GPC3]_L1.3 Light Chain
DVVMTQSPLSLPVTLGQPASISC<u>RSSQSLVHSSGNTYLH</u>WYQQRPGQSPRLLIY<u>KVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 304)

>XENP23067_GPC3-A_[GPC3]_H1_L1.4_IgG1_PVA_/S267K
Chain 1-GPC3-A_[GPC3]_H1_IgG1_PVA_/S267K Heavy Chain
QVQLVQSGAEVKKPGASVKVSCKASGYTFT<u>DYEMH</u>WVRQAPGQGLEWMG<u>ALDPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 305)
Chain 2-GPC3-A_[GPC3]_L1.4 Light Chain
DVVMTQSPLSLPVTLGQPASISC<u>RSSQSLVHSHGNTYLH</u>WYQQRPGQSPRLLIY<u>KVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 306)

>XENP23068_GPC3-A_[GPC3]_H1_L1.5_IgG1_PVA_/S267K
Chain 1-GPC3-A_[GPC3]_H1_IgG1_PVA_/S267K Heavy Chain
QVQLVQSGAEVKKPGASVKVSCKASGYTFT<u>DYEMH</u>WVRQAPGQGLEWMG<u>ALDPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 307)
Chain 2-GPC3-A_[GPC3]_L1.5 Light Chain
DVVMTQSPLSLPVTLGQPASISC<u>RSSQSLVHSNANTYLH</u>WYQQRPGQSPRLLIY<u>KVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 308)

>XENP23069_GPC3-A_[GPC3]_H1_L1.6_IgG1_PVA_/S267K
>Chain 1-GPC3-A_[GPC3]_H1_IgG1_PVA_/S267K Heavy Chain
QVQLVQSGAEVKKPGASVKVSCKASGYTFT<u>DYEMH</u>WVRQAPGQGLEWMG<u>ALDPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 309)

Figure 14D

Chain 2-GPC3-A_[GPC3]_L1.6 Light Chain
DVVMTQSPLSLPVTLGQPASISCRSSQSLVHSNTNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 310)

>XENP23070_GPC3-A_[GPC3]_H1_L1.7_IgG1_PVA_/S267K
Chain 1-GPC3-A_[GPC3]_H1_IgG1_PVA_/S267K Heavy Chain
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 311)
Chain 2-GPC3-A_[GPC3_L1.7 Light Chain
DVVMTQSPLSLPVTLGQPASISCRSSQSLVHSNKNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 312)

>XENP23071_GPC3-A_[GPC3]_H1_L1.8_IgG1_PVA_/S267K
Chain 1-GPC3-A_[GPC3]_H1_IgG1_PVA_/S267K Heavy Chain
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 313)
Chain 2-GPC3-A_[GPC3]_L1.8 Light Chain
DVVMTQSPLSLPVTLGQPASISCRSSQSLVHSNGQTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 314)

>XENP23072_GPC3-A_[GPC3]_H1_L1.9_IgG1_PVA_/S267K
Chain 1-GPC3-A_[GPC3]_H1_IgG1_PVA_/S267K Heavy Chain
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 315)
Chain 2-GPC3-A_[GPC3]_L1.9 Light Chain
DVVMTQSPLSLPVTLGQPASISCRSSQSLVHSNGYTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 316)

Figure 14E

>XENP23073_GPC3-A_[GPC3]_H1_L1.10_IgG1_PVA_/S267K
Chain 1-GPC3-A_[GPC3]_H1_IgG1_PVA_/S267K Heavy Chain
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 317)
Chain 2-GPC3-A_[GPC3]_L1.10 Light Chain
DVVMTQSPLSLPVTLGQPASISCRSSQSLVHSNGHTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 318)

>XENP35705 GPC3-A_H1.1_L1.16_[GPC3]_IgG1_PVA_/S267K
Chain 1-GPC3-A_H1.1_[GPC3]_IgG1_PVA_/S267K Heavy Chain
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 319)
Chain 2-GPC3-A[GPC3]_L1.16 Light Chain
DVVMTQSPLSLPVTLGQPASISCRSSQSLVHSSGNTYLHWYQQRPGQSPRLLIYKVSNRFSGVPDRFSGSGSGTDFT
LKISRVEAEDVGVYFCSQSTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID NO: 320)

>XENP35708 GPC3-A_H1.1_L1.31_[GPC3]_IgG1_PVA_/S267K
Chain 1-GPC3-A_H1.1_[GPC3]_IgG1_PVA_/S267K Heavy Chain
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLH
QDWLNGKEYKCKVSNKALPAPIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSLSPGK (SEQ ID NO: 321)
Chain 2-GPC3-A[GPC3]_L1.31 Light Chain
DVVMTQSPLSLPVTLGQPASISCRSSQSLVHSNGNTYLHWYQQRPGQSPRLLIYYVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 322)

Figure 16A

>XENP21971 GPC3-A_H1L1_[GPC3]_Fab-[ANTI-CD3]_H1.30_L1.47_scFv(GKPGS)4-IgG1_pI(-)_Isosteric_A_/PVA_/S267K/L368D/K370S-Fc(216)_IgG1_C220S/PVA_/S267K/S364K/E357Q
Chain 1-GPC3-A_H1_IgG1_pI(-)_Isosteric_A_/PVA_/S267K/L368D/K370S
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 323)

Chain 2-[ANTI-CD3]_H1.30_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 324)

Chain 3-GPC3-A_L1_[GPC3]_Light Chain
DVVMTQSPLSLPVTLGQPASISCRSSQSLVHSNGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 325)

>XENP34364 GPC3-A[GPC3]_H1.1_L1.16_Fab-[ANTI-CD3]_H1.30_L1.47_scFv(GKPGS)4-IgG1_pI(-)_Isosteric_A_/PVA_/S267K/L368D/K370S-Fc(216)_IgG1_C220S/PVA_/S267K/S364K/E357Q
Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 326)

Chain 2-[ANTI-CD3]_H1.30_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 327)

Chain 3-GPC3-A[GPC3]_L1.16_Light Chain
DVVMTQSPLSLPVTLGQPASISCRSSQSLVHSSGNTYLHWYQQRPGQSPRLLIYKVSNRFSGVPDRFSGSGSGTDFT
LKISRVEAEDVGVYFCSQSTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 328)

Figure 16B

>XENP34365 GPC3-A[GPC3]_H1.1_L1.23_Fab-[ANTI-CD3]_H1.30_L1.47_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 329)

Chain 2-[ANTI-CD3]_H1.30_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 330)

Chain 3-GPC3-A[GPC3]_L1.23_Light Chain
DVVMTQSPLSLPVTLGQPASISCRSSQSLVHSNGNTWLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 331)

>XENP34367 GPC3-A[GPC3]_H1.1_L1.29_Fab-[ANTI-CD3]_H1.30_L1.47_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 332)

Chain 2-[ANTI-CD3]_H1.30_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 333)

Chain 3-GPC3-A[GPC3]_L1.29_Light Chain
DVVMTQSPLSLPVTLGQPASISCRSSQSLVHSNGNTYLHWYQQRPGQSPRLLIYQVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 334)

Figure 16C

>XENP34368 GPC3-A[GPC3]_H1.1_L1.31_Fab-[ANTI-CD3]_H1.30_L1.47_scFv(GKPGS)4-IgG1_pI(-
)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 335)

Chain 2-GPC3-A[GPC3]_H1.1_Fab-[ANTI-CD3]_H1.30_L1.47_scFv(GKPGS)4-
Fc(216)_IgG1_C220S/PVA_/S267K/S364K/E357Q
EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 336)

Chain 3-GPC3-A[GPC3]_L1.31_Light Chain
DVVMTQSPLSLPVTLGQPASISCRSSQSLVHSNGNTYLHWYQQRPGQSPRLLIYYVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 337)

Figure 17A

**>XENP35843 GPC3-A[GPC3]_H1.1_L1.16_Fab-[ANTI-CD3]_H1.32_L1.47_scFv(GKPGS)4-IgG1_pI(-
)_Isosteric_A_/PVA_/S267K/L368D/K370S-Fc(216)_IgG1_C220S/PVA_/S267K/S364K/E357Q**
Chain 1-GPC3-A[GPC3]_H1.1_IgG1_pI(-)_Isosteric_A_/PVA_/S267K/L368D/K370S
QVQLVQSGAEVKKPGASVKVSCKASGYTFT<u>DYEMH</u>WVRQAPGQGLEWMGALEPKTGDTAYSQKFQGRVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 338)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVRH<u>GNFGDSYVSWFAY</u>WGQGTLVTVSS/<u>GKPGSGKPGSGKPGSGKPGS</u>/QAVVTQE
PSLTVSPGGTVTLTC<u>GSSTGAVTTSNYAN</u>WVQQKPGKSPRGLIGG<u>TNKRAP</u>GVPARFSGSLLGGKAALTISGAQPED
EADYYC<u>ALWYSNHWV</u>FGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 339)

Chain 3-GPC3-A[GPC3]_L1.16_Light Chain
DVVMTQSPLSLPVTLGQPASISC<u>RSSQSLVHSSGNTYLH</u>WYQQRPGQSPRLLIY<u>KVSNRFS</u>GVPDRFSGSGSGTDFT
LKISRVEAEDVGVYFC<u>SQSTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 340)

**>XENP36140 GPC3-A[GPC3]_H1.1_L1.31_Fab-[ANTI-CD3]_H1.32_L1.47_scFv(GKPGS)4-IgG1_pI(-
)_Isosteric_A_/PVA_/S267K/L368D/K370S-Fc(216)_IgG1_C220S/PVA_/S267K/S364K/E357Q**
Chain 1-GPC3-A[GPC3]_H1.1_IgG1_pI(-)_Isosteric_A_/PVA_/S267K/L368D/K370S
QVQLVQSGAEVKKPGASVKVSCKASGYTFT<u>DYEMH</u>WVRQAPGQGLEWMGALEPKTGDTAYSQKFQGRVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 341)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFS<u>TYAMN</u>WVRQAPGKGLEWVG<u>RIRSKANNYATYYADSVKG</u>RFTISRDDS
KNTLYLQMNSLRAEDTAVYYCVRH<u>GNFGDSYVSWFAY</u>WGQGTLVTVSS/<u>GKPGSGKPGSGKPGSGKPGS</u>/QAVVTQE
PSLTVSPGGTVTLTC<u>GSSTGAVTTSNYAN</u>WVQQKPGKSPRGLIGG<u>TNKRAP</u>GVPARFSGSLLGGKAALTISGAQPED
EADYYC<u>ALWYSNHWV</u>FGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 342)

Chain 3-GPC3-A[GPC3]_L1.31_Light Chain
DVVMTQSPLSLPVTLGQPASISC<u>RSSQSLVHSNGNTYLH</u>WYQQRPGQSPRLLIY<u>YVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 343)

Figure 17B

>XENP36931 GPC3-A[GPC3]_H1.1_L1.65_Fab-[ANTI-CD3]_H1.32_L1.47_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 344)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 345)

Chain 3-GPC3-A[GPC3]_L1.65_Light Chain
DVVMTQSPLSLPVTLGQPASISCRSSQSLVHSYGNTWLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 346)

>XENP36932 GPC3-A[GPC3]_H1.1_L1.66_Fab-[ANTI-CD3]_H1.32_L1.47_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 347)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 348)

Chain 3-GPC3-A[GPC3]_L1.66_Light Chain
DVVMTQSPLSLPVTLGQPASISCRSSQSLVHSNANTWLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 349)

Figure 17C

>XENP36933 GPC3-A[GPC3]_H1.1_L1.67_Fab-[ANTI-CD3]_H1.32_L1.47_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 350)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 351)

Chain 3-GPC3-A[GPC3]_L1.67_Light Chain
DVVMTQSPLSLPVTLGQPASISCRSSQSLVHSNKNTWLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 352)

>XENP36934 GPC3-A[GPC3]_H1.1_L1.68_Fab-[ANTI-CD3]_H1.32_L1.47_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 353)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 354)

Chain 3-GPC3-A[GPC3]_L1.68_Light Chain
DVVMTQSPLSLPVTLGQPASISCRSSQSLVHSYGNTYLHWYQQRPGQSPRLLIYQVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 355)

Figure 17D

**>XENP36935 GPC3-A[GPC3]_H1.1_L1.69_Fab-[ANTI-CD3]_H1.32_L1.47_scFv(GKPGS)4-IgG1_pI(-
)_Isosteric_A_/PVA_/S267K/L368D/K370S-Fc(216)_IgG1_C220S/PVA_/S267K/S364K/E357Q**
Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 356)

Chain 2- [ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 357)

Chain 3-GPC3-A[GPC3]_L1.69_Light Chain
DVVMTQSPLSLPVTLGQPASISCRSSQSLVHSNANTYLHWYQQRPGQSPRLLIYQVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 358)

**>XENP36936 GPC3-A[GPC3]_H1.1_L1.70_Fab-[ANTI-CD3]_H1.32_L1.47_scFv(GKPGS)4-IgG1_pI(-
)_Isosteric_A_/PVA_/S267K/L368D/K370S-Fc(216)_IgG1_C220S/PVA_/S267K/S364K/E357Q**
Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 359)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 360)

Chain 3-GPC3-A[GPC3]_L1.70_Light Chain
DVVMTQSPLSLPVTLGQPASISCRSSQSLVHSNKNTYLHWYQQRPGQSPRLLIYQVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 361)

Figure 17E

>XENP36937 GPC3-A[GPC3]_H1.1_L1.71_Fab-[ANTI-CD3]_H1.32_L1.47_scFv(GKPGS)4-IgG1_pI(-)_Isosteric_A_/PVA_/S267K/L368D/K370S-Fc(216)_IgG1_C220S/PVA_/S267K/S364K/E357Q
Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 362)
>Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 363)
>Chain 3-GPC3-A[GPC3]_L1.71_Light Chain
DVVMTQSPLSLPVTLGQPASISCRSSQSLVHSYGNTYLHWYQQRPGQSPRLLIYYVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 364)

>XENP36938 GPC3-A[GPC3]_H1.1_L1.72_Fab-[ANTI-CD3]_H1.32_L1.47_scFv(GKPGS)4-IgG1_pI(-)_Isosteric_A_/PVA_/S267K/L368D/K370S-Fc(216)_IgG1_C220S/PVA_/S267K/S364K/E357Q
Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 365)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 366)

Chain 3-GPC3-A[GPC3]_L1.72_Light Chain
DVVMTQSPLSLPVTLGQPASISCRSSQSLVHSNANTYLHWYQQRPGQSPRLLIYYVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 367)

Figure 17F

>XENP36939_GPC3-A[GPC3]_H1.1_L1.73_Fab-[ANTI-CD3]_H1.32_L1.47_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 368)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 369)

Chain 3-GPC3-A[GPC3]_L1.73_Light Chain
DVVMTQSPLSLPVTLGQPASISCRSSQSLVHSNKNTYLHWYQQRPGQSPRLLIYYVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 370)

>XENP36941_GPC3-A[GPC3]_H1.1_L1.29_Fab-[ANTI-CD3]_H1.32_L1.47_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 371)

Chain 2-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 372)

Chain 3-GPC3-A[GPC3]_L1.29_Light Chain
DVVMTQSPLSLPVTLGQPASISCRSSQSLVHSNGNTYLHWYQQRPGQSPRLLIYQVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 373)

Figure 17G

>XENP38087 GPC3-A[GPC3]_H1.1_L1.69_Fab-[ANTI-CD3]_H1.32_L1.47_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S

Chain 1-GPC3-A[GPC3]_H1.1_IgG1_pI(-)_Isosteric_A_/PVA_/S267K/L368D/K370S/M428L/N434S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVLHEALHSHYTQKSLSLSPGK (SEQ ID NO: 374)

Chain 2-[ANTI-CD3]_H1.32_L1.47_scFv(GKPGS)4-Fc(216)_IgG1_C220S/PVA_/S267K/S364K/E357Q/M428L/N434S
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVLHEALHSHYTQKSLSLSPGK (SEQ ID NO: 375)

Chain 3-GPC3-A[GPC3]_L1.69_Light Chain
DVVMTQSPLSLPVTLGQPASISCRSSQSLVHSNANTYLHWYQQRPGQSPRLLIYQVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID NO: 376)

Figure 18A

>XENP33744 GPC3-A[GPC3]_H1L1_Fab-GPC3-A[GPC3]_H1L1_Fab_(G4S)2_[ANTI-CD3]_H1.30_L1.47_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q

Chain 1-GPC3-A[GPC3]_H1_IgG1_pI(-)_Isosteric_A_/PVA_/S267K/L368D/K370S
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 377)

Chain 2-GPC3-A[GPC3]_H1_Fab_(G4S)2_[ANTI-CD3]_H1.30_L1.47_scFv(GKPGS)4_(G4S)2-Fc(222)_IgG1_C220S/PVA_/S267K/S364K/E357Q
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 378)

Chain 3-GPC3-A[GPC3]_L1_Light Chain
DVVMTQSPLSLPVTLGQPASISCRSSQSLVHSNGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID NO: 379)

Figure 18B

>XENP33745 GPC3-A[GPC3]_H1L1_Fab-GPC3-A[GPC3]_H1L1_Fab_(G4S)2_[ANTI-
CD3]_L1.47_H1.30_scFv(GKPGS)4_(G4S)2-IgG1_pI(-)_Isosteric_A_/PVA_/S267K/L368D/K370S-
Fc(222)_IgG1_C220S/PVA_/S267K/S364K/E357Q
Chain 1-GPC3-A[GPC3]_H1_IgG1_pI(-)_Isosteric_A_/PVA_/S267K/L368D/K370S
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 380)

**Chain 2-GPC3-A[GPC3]_H1_Fab_(G4S)2_[ANTI-CD3]_L1.47_H1.30_scFv(GKPGS)4_(G4S)2-
Fc(222)_IgG1_C220S/PVA_/S267K/S364K/E357Q**
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKYNNYATYYADSVKGRFTISRDDSKNTLYLQMNSLRAEDTAVYYCVR
HGNFGDSYVSWFAYWGQGTLVTVSS/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 381)

Chain 3-GPC3-A[GPC3]_L1_Light Chain
DVVMTQSPLSLPVTLGQPASISCRSSQSLVHSNGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 382)

Figure 19A

>XENP27259 GPC3-A[GPC3]_H1L1_Fab-GPC3-A[GPC3]_H1L1_Fab_(G4S)2_[ANTI-
CD3]_H1.32_L1.47_scFv(GKPGS)4_(G4S)2-IgG1_pI(-)_Isosteric_A_/PVA_/S267K/L368D/K370S-
Fc(222)_IgG1_C220S/PVA_/S267K/S364K/E357Q
Chain 1-GPC3-A[GPC3]_H1_IgG1_pI(-)_Isosteric_A_/PVA_/S267K/L368D/K370S
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 383)

**Chain 2-GPC3-A[GPC3]_H1_Fab_(G4S)2_[ANTI-CD3]_H1.32_L1.47_scFv(GKPGS)4_(G4S)2-
Fc(222)_IgG1_C220S/PVA_/S267K/S364K/E357Q**
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGKAALTISGAQPED
EADYYCALWYSNHWVFGGGTKLTVL/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 384)

Chain 3-GPC3-A[GPC3]_L1_Light Chain
DVVMTQSPLSLPVTLGQPASISCRSSQSLVHSNGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 385)

>XENP33746 GPC3-A[GPC3]_H1L1_Fab-GPC3-A[GPC3]_H1L1_Fab_(G4S)2_[ANTI-
CD3]_L1.47_H1.32_scFv(GKPGS)4_(G4S)2-IgG1_pI(-)_Isosteric_A_/PVA_/S267K/L368D/K370S-
Fc(222)_IgG1_C220S/PVA_/S267K/S364K/E357Q
Chain 1-GPC3-A[GPC3]_H1L1_IgG1_pI(-)_Isosteric_A_/PVA_/S267K/L368D/K370S
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 386)

**Chain 2-GPC3-A[GPC3]_H1_Fab_(G4S)2_[ANTI-CD3]_L1.47_H1.32_scFv(GKPGS)4_(G4S)2-
Fc(222)_IgG1_C220S/PVA_/S267K/S364K/E357Q**
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCGGGGSGGGGSQA
VVTQEPSLTVSPGGTVTLTCGSSTGAVTTSNYANWVQQKPGKSPRGLIGGTNKRAPGVPARFSGSLLGKAALTISG
AQPEDEADYYCALWYSNHWVFGGGTKLTVLGKPGSGKPGSGKPGSGKPGSEVQLVESGGGLVQPGGSLRLSCAASGF
TFSTYAMNWVRQAPGKGLEWVGRIRSKANNYATYYADSVKGRFTISRDDSKNTLYLQMNSLRAEDTAVYYCVRHGNF
GDSYVSWFAYWGQGTLVTVSSGGGGSGGGGSKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 387)

Figure 19B

Chain 3-GPC3-A[GPC3]_L1_Light Chain
DVVMTQSPLSLPVTLGQPASISCRSSQSLVHSNGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 388)

>XENP34919 GPC3-A[GPC3]_H1.1_L1.6_Fab-GPC3-A[GPC3]_H1.1_L1.6_Fab_(G4S)2_[ANTI-CD3]_L1.47_H1.32_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q
Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 389)

Chain 2-GPC3-A[GPC3]_H1.1_Fab_(G4S)2_[ANTI-CD3]_L1.47_H1.32_scFv(GKPGS)4_(G4S)2-Fc(222)_IgG1_C220S/PVA_/S267K/S364K/E357Q
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 390)

Chain 3-GPC3-A[GPC3]_L1.6_Light Chain
DVVMTQSPLSLPVTLGQPASISCRSSQSLVHSNTNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 391)

>XENP34920 GPC3-A[GPC3]_H1.1_L1.16_Fab-GPC3-A[GPC3]_H1.1_L1.16_Fab_(G4S)2_[ANTI-CD3]_L1.47_H1.32_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q
Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 392)

Figure 19C

Chain 2-GPC3-A[GPC3]_H1.1_Fab_(G4S)2_[ANTI-CD3]_L1.47_H1.32_scFv(GKPGS)4_(G4S)2-Fc(222)_IgG1_C220S/PVA_/S267K/S364K/E357Q
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/<u>GGGGSGGGGS</u>/
QAVVTQEPSLTVSPGGTVTLTC<u>GSSTGAVTTSNYAN</u>WVQQKPGKSPRGLIGG<u>TNKRAP</u>GVPARFSGSLLGGKAALTI
SGAQPEDEADYYC<u>ALWYSNHWV</u>FGGGTKLTVL/<u>GKPGSGKPGSGKPGSGKPGS</u>/EVQLVESGGGLVQPGGSLRLSCA
ASGFTFS<u>TYAMN</u>WVRQAPGKGLEWVG<u>RIRSKANNYATYYADSVKG</u>RFTISRDDSKNTLYLQMNSLRAEDTAVYYCVR
<u>HGNFGDSYVSWFAY</u>WGQGTLVTSS/<u>GGGGSGGGGS</u>/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 393)

Chain 3-GPC3-A[GPC3]_L1.16_Light Chain
DVVMTQSPLSLPVTLGQPASISC<u>RSSQSLVHSSGNTYLH</u>WYQQRPGQSPRLLIY<u>KVSNRFS</u>GVPDRFSGSGSGTDFT
LKISRVEAEDVGVYFC<u>SQSTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 394)

>XENP34921 GPC3-A[GPC3]_H1.1_L1.23_Fab-GPC3-A[GPC3]_H1.1_L1.23_Fab_(G4S)2_[ANTI-CD3]_L1.47_H1.32_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q
Chain 1-GPC3-A[GPC3]_H1.1_IgG1_pI(-)_Isosteric_A_/PVA_/S267K/L368D/K370S
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 395)

Chain 2-GPC3-A[GPC3]_H1.1_Fab_(G4S)2_[ANTI-CD3]_L1.47_H1.32_scFv(GKPGS)4_(G4S)2-Fc(222)_IgG1_C220S/PVA_/S267K/S364K/E357Q
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/<u>GGGGSGGGGS</u>/
QAVVTQEPSLTVSPGGTVTLTC<u>GSSTGAVTTSNYAN</u>WVQQKPGKSPRGLIGG<u>TNKRAP</u>GVPARFSGSLLGGKAALTI
SGAQPEDEADYYC<u>ALWYSNHWV</u>FGGGTKLTVL/<u>GKPGSGKPGSGKPGSGKPGS</u>/EVQLVESGGGLVQPGGSLRLSCA
ASGFTFS<u>TYAMN</u>WVRQAPGKGLEWVG<u>RIRSKANNYATYYADSVKG</u>RFTISRDDSKNTLYLQMNSLRAEDTAVYYCVR
<u>HGNFGDSYVSWFAY</u>WGQGTLVTSS/<u>GGGGSGGGGS</u>/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 396)

Chain 3-GPC3-A[GPC3]_L1.23_Light Chain
DVVMTQSPLSLPVTLGQPASISC<u>RSSQSLVHSNGNTWLH</u>WYQQRPGQSPRLLIY<u>KVSNRFS</u>GVPDRFSGSGSGTDFT
LKISRVEAEDVGVYFC (SEQ ID NO: 397)

Figure 19D

>XENP34922 GPC3-A[GPC3]_H1.1_L1.29_Fab-GPC3-A[GPC3]_H1.1_L1.29_Fab_(G4S)2_[ANTI-CD3]_L1.47_H1.32_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 398)

Chain 2-GPC3-A[GPC3]_H1.1_Fab_(G4S)2_[ANTI-CD3]_L1.47_H1.32_scFv(GKPGS)4_(G4S)2-Fc(222)_IgG1_C220S/PVA_/S267K/S364K/E357Q
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 399)

Chain 3-GPC3-A[GPC3]_L1.29_Light Chain
DVVMTQSPLSLPVTLGQPASISCRSSQSLVHSNGNTYLHWYQQRPGQSPRLLIYQVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID NO: 400)

>XENP34923 GPC3-A[GPC3]_H1.1_L1.31_Fab-GPC3-A[GPC3]_H1.1_L1.31_Fab_(G4S)2_[ANTI-CD3]_L1.47_H1.32_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 401)

Chain 2-GPC3-A[GPC3]_H1.1_Fab_(G4S)2_[ANTI-CD3]_L1.47_H1.32_scFv(GKPGS)4_(G4S)2-Fc(222)_IgG1_C220S/PVA_/S267K/S364K/E357Q
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 402)

Figure 19E

Chain 3-GPC3-A[GPC3]_L1.31_Light Chain
DVVMTQSPLSLPVTLGQPASISCRSSQSLVHSNGNTYLHWYQQRPGQSPRLLIYYVSNRFSGVPDRFSGSGSGTDFT
LKISRVEAEDVGVYFCSQNTHVPPTFGSTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 403)

**>XENP35840 GPC3-A[GPC3]_H1_L1.16_Fab-GPC3-A[GPC3]_H1_L1.16_Fab_(G4S)2_[ANTI-
CD3]_H1.32_L1.47_scFv(GKPGS)4_(G4S)2-IgG1_pI(-)_Isosteric_A_/PVA_/S267K/L368D/K370S-
Fc(222)_IgG1_C220S/PVA_/S267K/S364K/E357Q**
Chain 1-GPC3-A[GPC3]_H1_IgG1_pI(-)_Isosteric_A_/PVA_/S267K/L368D/K370S
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 404)

**Chain 2-GPC3-A[GPC3]_H1_Fab_(G4S)2_[ANTI-CD3]_H1.32_L1.47_scFv(GKPGS)4_(G4S)2-
Fc(222)_IgG1_C220S/PVA_/S267K/S364K/E357Q**
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 405)

Chain 3-GPC3-A[GPC3]_L1.16_Light Chain
DVVMTQSPLSLPVTLGQPASISCRSSQSLVHSSGNTYLHWYQQRPGQSPRLLIYKVSNRFSGVPDRFSGSGSGTDFT
LKISRVEAEDVGVYFCSQSTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 406)

**>XENP35840 GPC3-A[GPC3]_H1_L1.16_Fab-GPC3-A[GPC3]_H1_L1.16_Fab_(G4S)2_[ANTI-
CD3]_H1.32_L1.47_scFv(GKPGS)4_(G4S)2-IgG1_pI(-)_Isosteric_A_/PVA_/S267K/L368D/K370S-
Fc(222)_IgG1_C220S/PVA_/S267K/S364K/E357Q**
Chain 1-GPC3-A[GPC3]_H1_IgG1_pI(-)_Isosteric_A_/PVA_/S267K/L368D/K370S
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 404)

Figure 19F

Chain 2-GPC3-A[GPC3]_H1_Fab_(G4S)2_[ANTI-CD3]_H1.32_L1.47_scFv(GKPGS)4_(G4S)2-Fc(222)_IgG1_C220S/PVA_/S267K/S364K/E357Q
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 405)

Chain 3-GPC3-A[GPC3]_L1.16_Light Chain
DVVMTQSPLSLPVTLGQPASISCRSSQSLVHSSGNTYLHWYQQRPGQSPRLLIYKVSNRFSGVPDRFSGSGSGTDFT
LKISRVEAEDVGVYFCSQSTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID NO: 407)

>XENP37246 GPC3-A[GPC3]_H1.1_L1.16_Fab_(G4S)2_GPC3-A[GPC3]_H1.1_L1.16_Fab-[ANTI-CD3]_H1.32_L1.47_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSC/GGGGSGGGGS/
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 408)

Chain 2-GPC3-A[GPC3]_H1.1_Fab-[ANTI-CD3]_H1.32_L1.47_scFv(GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS/GKPGSGKPGSGKPGSGKPGS/QAVVTQE
PSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLEPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVMHEALHNHYTQKSLSLSPGK (SEQ ID NO: 409)

Chain 3-GPC3-A[GPC3]_L1.16_Light Chain
DVVMTQSPLSLPVTLGQPASISCRSSQSLVHSSGNTYLHWYQQRPGQSPRLLIYKVSNRFSGVPDRFSGSGSGTDFT
LKISRVEAEDVGVYFCSQSTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID NO: 410)

Figure 19G

>XENP37247 GPC3-A[GPC3]_H1.1_L1.16_Fab_(G4S)2_GPC3-A[GPC3]_H1.1_L1.16_Fab-[ANTI-
CD3]_L1.47_H1.32_scFv(GKPGS)4-IgG1_pI(-)_Isosteric_A_/PVA_/S267K/L368D/K370S-
Fc(216)_IgG1_C220S/PVA_/S267K/S364K/E357Q
Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCGGGGSGGGGSQV
QLVQSGAEVKKPGASVKVSCKASGYTFTDYEMHWVRQAPGQGLEWMGALEPKTGDTAYSQKFQGRVTMTADKSISTA
YMELSRLRSDDTAVYYCTRFYSYTYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK (SEQ ID NO: 411)

**Chain 2-GPC3-A[GPC3]_H1.1_Fab-[ANTI-CD3]_L1.47_H1.32_scFv(GKPGS)4-
Fc(216)_IgG1_C220S/PVA_/S267K/S364K/E357Q**
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 412)

Chain 3-GPC3-A[GPC3]_L1.16_Light Chain
DVVMTQSPLSLPVTLGQPASISCRSSQSLVHSSGNTYLHWYQQRPGQSPRLLIYKVSNRFSGVPDRFSGSGSGTDFT
LKISRVEAEDVGVYFCSQSTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 413)

>XENP38086 GPC3-A[GPC3]_H1.1_L1.16_Fab-GPC3-A[GPC3]_H1.1_L1.16_Fab_(G4S)2_[ANTI-
CD3]_L1.47_H1.32_scFv(GKPGS)4_(G4S)2-IgG1_pI(-)_Isosteric_A_/PVA_/S267K/L368D/K370S/M428L/N434S-
Fc(222)_IgG1_C220S/PVA_/S267K/S364K/E357Q/M428L/N434S
Chain 1-GPC3-A[GPC3]_H1.1_IgG1_pI(-)_Isosteric_A_/PVA_/S267K/L368D/K370S/M428L/N434S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVLHEALHSHYTQKSLSLSPGK (SEQ ID NO: 414)

**Chain 2-GPC3-A[GPC3]_H1.1_Fab_(G4S)2_[ANTI-CD3]_L1.47_H1.32_scFv(GKPGS)4_(G4S)2-
Fc(222)_IgG1_C220S/PVA_/S267K/S364K/E357Q/M428L/N434S**
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVLHEALHSHYTQKSLSLSPGK (SEQ ID NO: 415)

Figure 19H

Chain 3-GPC3-A[GPC3]_L1.16_Light Chain
DVVMTQSPLSLPVTLGQPASISCRSSQSLVHSSGNTYLHWYQQRPGQSPRLLIYKVSNRFSGVPDRFSGSGSGTDFT
LKISRVEAEDVGVYFCSQSTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 416)

Figure 20A

>XENP33747 GPC3-A[GPC3]_H1L1_Fab-GPC3-A[GPC3]_H1L1_Fab_(G4S)2_[ANTI-CD3]_L1.47_H1.89_scFv(GKPGS)4-IgG1_pI(-)_Isosteric_A_/PVA_/S267K/L368D/K370S-Fc(216)_IgG1_C220S/PVA_/S267K/S364K/E357Q

Chain 1-GPC3-A[GPC3]_H1_IgG1_pI(-)_Isosteric_A_/PVA_/S267K/L368D/K370S
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 417)

Chain 2-GPC3-A[GPC3]_H1_Fab_(G4S)2_[ANTI-CD3]_L1.47_H1.89_scFv(GKPGS)4-Fc(216)_IgG1_C220S/PVA_/S267K/S364K/E357Q
QVQLVQSGAEVKKPGASVKVSCKASGYTFTDYEMHWVRQAPGQGLEWMGALDPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKYNNYATYYADSVKGRFTISRDDSKNTLYLQMNSLRAEDTAVYYCVR
HGNFGDEYVSWFAYWGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 418)

Chain 3-GPC3-A[GPC3]_L1_Light Chain
DVVMTQSPLSLPVTLGQPASISCRSSQSLVHSNGNTYLHWYQQRPGQSPRLLIYKVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID NO: 419)

>XENP35841 GPC3-A[GPC3]_H1.1_L1.16_Fab-GPC3-A[GPC3]_H1.1_L1.16_Fab_(G4S)2_[ANTI-CD3]_L1.47_H1.89_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 420)

Chain 2-GPC3-A[GPC3]_H1.1_Fab_(G4S)2_[ANTI-CD3]_L1.47_H1.89_scFv(GKPGS)4_(G4S)2-Fc(222)_IgG1_C220S/PVA_/S267K/S364K/E357Q
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKYNNYATYYADSVKGRFTISRDDSKNTLYLQMNSLRAEDTAVYYCVR
HGNFGDEYVSWFAYWGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 421)

Figure 20B

Chain 3-GPC3-A[GPC3]_L1.16_Light Chain
DVVMTQSPLSLPVTLGQPASISCRSSQSLVHSSGNTYLHWYQQRPGQSPRLLIYKVSNRFSGVPDRFSGSGSGTDFT
LKISRVEAEDVGVYFCSQSTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 422)

>XENP37624 GPC3-A[GPC3]_H1.1_L1.16_Fab-GPC3-A[GPC3]_H1.1_L1.16_Fab_(G4S)2_[ANTI-
CD3]_L1.47_H1.89_scFv(GKPGS)4_(G4S)2-IgG1_pI(-)_Isosteric_A_/PVA_/S267K/L368D/K370S-
Fc(222)_IgG1_C220S/PVA_/S267K/S364K/E357Q
Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 423)

**Chain 2-GPC3-A[GPC3]_H1.1_Fab_(G4S)2_[ANTI-CD3]_L1.47_H1.89_scFv(GKPGS)4_(G4S)2-
Fc(222)_IgG1_C220S/PVA_/S267K/S364K/E357Q**
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKYNNYATYYADSVKGRFTISRDDSKNTLYLQMNSLRAEDTAVYYCVR
HGNFGDEYVSWFAYWGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 424)

Chain 3-GPC3-A[GPC3]_L1.16_Light Chain
DVVMTQSPLSLPVTLGQPASISCRSSQSLVHSSGNTYLHWYQQRPGQSPRLLIYKVSNRFSGVPDRFSGSGSGTDFT
LKISRVEAEDVGVYFCSQSTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 425)

>XENP37625 GPC3-A[GPC3]_H1.1_L1.69_Fab-GPC3-A[GPC3]_H1.1_L1.69_Fab_(G4S)2_[ANTI-
CD3]_L1.47_H1.89_scFv(GKPGS)4-IgG1_pI(-)_Isosteric_A_/PVA_/S267K/L368D/K370S-
Fc(216)_IgG1_C220S/PVA_/S267K/S364K/E357Q
Chain 1-GPC3-A[GPC3]_H1.1_Fab-GPC3-A[GPC3]_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 426)

Figure 20C

Chain 2-GPC3-A[GPC3]_H1.1_L1.69_Fab_(G4S)2_[ANTI-CD3]_L1.47_H1.89_scFv(GKPGS)4-Fc(216)_IgG1_C220S/PVA_/S267K/S364K/E357Q
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/<u>GGGGSGGGGS</u>/
QAVVTQEPSLTVSPGGTVTLTC<u>GSSTGAVTTSNYAN</u>WVQQKPGKSPRGLIG<u>GTNKRAP</u>GVPARFSGSLLGGKAALTI
SGAQPEDEADYYC<u>ALWYSNHWV</u>FGGGTKLTVL/<u>GKPGSGKPGSGKPGSGKPGS</u>/EVQLVESGGGLVQPGGSLRLSCA
ASGFTFS<u>TYAMN</u>WVRQAPGKGLEWVG<u>RIRSKYNNYATYYADSVKG</u>RFTISRDDSKNTLYLQMNSLRAEDTAVYYCVR
<u>HGNFGDEYVSWFAY</u>WGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 427)

Chain 3-GPC3-A[GPC3]_L1.69_Light Chain
DVVMTQSPLSLPVTLGQPASISC<u>RSSQSLVHSNANTYLH</u>WYQQRPGQSPRLLIY<u>QVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 428)

><u>XENP37626 GPC3-A[GPC3]_H1.1_L1.73_Fab-GPC3-A[GPC3]_H1.1_L1.73_Fab_(G4S)2_[ANTI-CD3]_L1.47_H1.89_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q</u>

Chain 1-GPC3-A[GPC3]_H1.1_IgG1_pI(-)_Isosteric_A_/PVA_/S267K/L368D/K370S
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 429)

Chain 2-GPC3-A[GPC3]_H1.1_Fab_(G4S)2_[ANTI-CD3]_L1.47_H1.89_scFv(GKPGS)4_(G4S)2-Fc(222)_IgG1_C220S/PVA_/S267K/S364K/E357Q
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/<u>GGGGSGGGGS</u>/
QAVVTQEPSLTVSPGGTVTLTC<u>GSSTGAVTTSNYAN</u>WVQQKPGKSPRGLIG<u>GTNKRAP</u>GVPARFSGSLLGGKAALTI
SGAQPEDEADYYC<u>ALWYSNHWV</u>FGGGTKLTVL/<u>GKPGSGKPGSGKPGSGKPGS</u>/EVQLVESGGGLVQPGGSLRLSCA
ASGFTFS<u>TYAMN</u>WVRQAPGKGLEWVG<u>RIRSKYNNYATYYADSVKG</u>RFTISRDDSKNTLYLQMNSLRAEDTAVYYCVR
<u>HGNFGDEYVSWFAY</u>WGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVMHEALHNHYTQKSLSLSPGK (SEQ ID NO: 430)

Chain 3-GPC3-A[GPC3]_L1.73_Light Chain
DVVMTQSPLSLPVTLGQPASISC<u>RSSQSLVHSNKNTYLH</u>WYQQRPGQSPRLLIY<u>YVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 431)

Figure 20D

>XENP38232 GPC3-A[GPC3]_H1.1_L1.69_Fab-GPC3-A[GPC3]_H1.1_L1.69_Fab_(G4S)2_[ANTI-CD3]_L1.47_H1.89_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1-GPC3-A[GPC3]_H1.1_IgG1_pI(-)_Isosteric_A_/PVA_/S267K/L368D/K370S/M428L/N434S
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVLHEALHSHYTQKSLSLSPGK (SEQ ID NO: 432)

Chain 2-GPC3-A[GPC3]_H1.1_Fab_(G4S)2_[ANTI-CD3]_L1.47_H1.89_scFv(GKPGS)4-Fc(216)_IgG1_C220S/PVA_/S267K/S364K/E357Q/M428L/N434S
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/<u>GGGGSGGGGS</u>/
QAVVTQEPSLTVSPGGTVTLTC<u>GSSTGAVTTSNYAN</u>WVQQKPGKSPRGLIGG<u>TNKRAP</u>GVPARFSGSLLGGKAALTI
SGAQPEDEADYYC<u>ALWYSNHWV</u>FGGGTKLTVL/<u>GKPGSGKPGSGKPGSGKPGS</u>/EVQLVESGGGLVQPGGSLRLSCA
ASGFTFS<u>TYAMN</u>WVRQAPGKGLEWVG<u>RIRSKYNNYATYYADSVKG</u>RFTISRDDSKNTLYLQMNSLRAEDTAVYYCVR
<u>HGNFGDEYVSWFAY</u>WGQGTLVTVSS/EPKSSDKTHTCPPCPAPPVAGPSVFLFPPKPKDTLMISRTPEVTCVVVDVK
HEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGN
VFSCSVLHEALHSHYTQKSLSLSPGK (SEQ ID NO: 433)

Chain 3-GPC3-A[GPC3]_L1.69_Light Chain
DVVMTQSPLSLPVTLGQPASISC<u>RSSQSLVHSNANTYLH</u>WYQQRPGQSPRLLIY<u>QVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID NO: 434)

>XENP37430 GPC3-A[GPC3]_H1.1_L1.69_Fab-GPC3-A[GPC3]_H1.1_L1.69_Fab_(G4S)2_[ANTI-CD3]_L1.47_H1.32_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 435)

Chain 2-GPC3-A[GPC3]_H1.1_Fab_(G4S)2_[ANTI-CD3]_L1.47_H1.32_scFv(GKPGS)4_(G4S)2-Fc(222)_IgG1_C220S/PVA_/S267K/S364K/E357Q
QVQLVQSGAEVKKPGASVKVSCKASGYTFT<u>DYEMH</u>WVRQAPGQGLEWMG<u>ALEPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/<u>GGGGSGGGGS</u>/
QAVVTQEPSLTVSPGGTVTLTC<u>GSSTGAVTTSNYAN</u>WVQQKPGKSPRGLIGG<u>TNKRAP</u>GVPARFSGSLLGGKAALTI
SGAQPEDEADYYC<u>ALWYSNHWV</u>FGGGTKLTVL/<u>GKPGSGKPGSGKPGSGKPGS</u>/EVQLVESGGGLVQPGGSLRLSCA
ASGFTFS<u>TYAMN</u>WVRQAPGKGLEWVG<u>RIRSKANNYATYYADSVKG</u>RFTISRDDSKNTLYLQMNSLRAEDTAVYYCVR
<u>HGNFGDSYVSWFAY</u>WGQGTLVTVSS/<u>GGGGSGGGGS</u>/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 436)

Figure 20E

Chain 3-GPC3-A[GPC3]_L1.69_Light Chain
DVVMTQSPLSLPVTLGQPASISCRSSQSLVHSNANTYLHWYQQRPGQSPRLLIYQVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 437)

>XENP37433 GPC3-A[GPC3]_H1.1_L1.73_Fab-GPC3-A[GPC3]_H1.1_L1.73_Fab_(G4S)2_[ANTI-CD3]_L1.47_H1.32_scFv(GKPGS)4_(G4S)2-IgG1_pI(-)_Isosteric_A_/PVA_/S267K/L368D/K370S-Fc(222)_IgG1_C220S/PVA_/S267K/S364K/E357Q

Chain 1-GPC3-A[GPC3]_H1.1_IgG1_pI(-)_Isosteric_A_/PVA_/S267K/L368D/K370S
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 438)

Chain 2-GPC3-A[GPC3]_H1.1_Fab_(G4S)2_[ANTI-CD3]_L1.47_H1.32_scFv(GKPGS)4_(G4S)2-Fc(222)_IgG1_C220S/PVA_/S267K/S364K/E357Q
QVQLVQSGAEVKKPGASVKVSCKASGYTFTDYEMHWVRQAPGQGLEWMGALEPKTGDTAYSQKFQGRVTMTADKSIS
TAYMELSRLRSDDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/GGGGSGGGGS/
QAVVTQEPSLTVSPGGTVTLTCGSSTGAVTTSNYANWVQQKPGKSPRGLIGGTNKRAPGVPARFSGSLLGGKAALTI
SGAQPEDEADYYCALWYSNHWVFGGGTKLTVL/GKPGSGKPGSGKPGSGKPGS/EVQLVESGGGLVQPGGSLRLSCA
ASGFTFSTYAMNWVRQAPGKGLEWVGRIRSKANNYATYYADSVKGRFTISRDDSKNTLYLQMNSLRAEDTAVYYCVR
HGNFGDSYVSWFAYWGQGTLVTVSS/GGGGSGGGGS/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 439)

Chain 3-GPC3-A[GPC3]_L1.73_Light Chain
DVVMTQSPLSLPVTLGQPASISCRSSQSLVHSNKNTYLHWYQQRPGQSPRLLIYYVSNRFSGVPDRFSGSGSGTDFT
LKISRVEAEDVGVYFCSQNTHVPPTFGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 440)

Figure 21

>XENP33748_GPC3-A[GPC3]_H1L1_Fab-GPC3-A[GPC3]_H1L1_Fab_(G4S)2_[ANTI-
CD3]_L1.47_H1.33_scFv(GKPGS)4_(G4S)2-IgG1_pI(-)_Isosteric_A_/PVA_/S267K/L368D/K370S-
Fc(222)_IgG1_C220S/PVA_/S267K/S364K/E357Q
Chain 1-GPC3-A[GPC3]_H1_IgG1_pI(-)_Isosteric_A_/PVA_/S267K/L368D/K370S
QVQLVQSGAEVKKPGASVKVSCKASGYTFT<u>DYEMH</u>WVRQAPGQGLEWMG<u>ALDPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 441)

**Chain 2-GPC3-A[GPC3]_H1_Fab_(G4S)2_[ANTI-CD3]_L1.47_H1.33_scFv(GKPGS)4_(G4S)2-
Fc(222)_IgG1_C220S/PVA_/S267K/S364K/E357Q**
QVQLVQSGAEVKKPGASVKVSCKASGYTFT<u>DYEMH</u>WVRQAPGQGLEWMG<u>ALDPKTGDTAYSQKFQG</u>RVTMTADKSIS
TAYMELSRLRSDDTAVYYCTR<u>FYSYTY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSC/<u>GGGGSGGGGS</u>/
QAVVTQEPSLTVSPGGTVTLTC<u>GSSTGAVTTSNYANW</u>VQQKPGKSPRGLIG<u>GTNKRAP</u>GVPARFSGSLLGGKAALTI
SGAQPEDEADYYC<u>ALWYSNHWV</u>FGGGTKLTVL/<u>GKPGSGKPGSGKPGSGKPGS</u>/EVQLVESGGGLVQPGGSLRLSCA
ASGFTFS<u>TYAMN</u>WVRQAPGKGLEWVG<u>RIRSKYNNYATYYADSVKG</u>RFTISRDDSKNTLYLQMNSLRAEDTAVYYCVR
<u>HGNFGDSYVSWFDY</u>WGQGTLVTVSS/<u>GGGGSGGGGS</u>/KTHTCPPCPAPPVAGPSVFLFPPKPKDTLMISRTPEVTCV
VVDVKHEDPEVKFNWYVDGVEVHNAKTKPREEQYNSTYRVVSVLTVLHQDWLNGKEYKCKVSNKALPAPIEKTISKA
KGQPREPQVYTLPPSREQMTKNQVKLTCLVKGFYPSDIAVEWESNGQPENNYKTTPPVLDSDGSFFLYSKLTVDKSR
WQQGNVFSCSVMHEALHNHYTQKSLSLSPGK (SEQ ID NO: 442)

Chain 3-GPC3-A[GPC3]_L1_Light Chain
DVVMTQSPLSLPVTLGQPASISC<u>RSSQSLVHSNGNTYLH</u>WYQQRPGQSPRLLIY<u>KVSNRFS</u>GVPDRFSGSGSGTDFT
LKISRVEAEDVGVYFC<u>SQNTHVPPT</u>FGSGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 443)

Figure 22

>XENP31308_GCH065[GPC3]_H0L0_Fab-TR01H113[CD3]_H0L0_Fab-IgG1_pI(-)_Isosteric_A_PVA_/S267K/L368D/K370S-Fc(222)_IgG1_PVA_/S267K/S364K/E357Q

Chain 1-GCH065[GPC3]_H0_Fab_IgG1_pI(-)_Isosteric_A_PVA_/S267K/L368D/K370S
QVQLVQSGAEVKKPGASVTVSCKASGYTFTDYEMHWIRQPPGEGLEWIGAIDGPTFDTAYSEKFKGRVTLTADKSTS
TAYMELSSLTSEDTAVYYCTRFYSYTYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAP
PVAGPSVFLFPPKPKDTLMISRTPEVTCVVVDVKHEDPEVKFNWYVDGVEVHNAKTKPREEEYNSTYRVVSVLTVLH
QDWLNGKEYKCKVSNKALPAPIEKTISKAKGQPREPQVYTLPPSREEMTKNQVSLTCDVSGFYPSDIAVEWESDGQP
ENNYKTTPPVLDSDGSFFLYSKLTVDKSRWEQGDVFSCSVMHEALHNHYTQKSLSLSPGK (SEQ ID NO: 444)

Chain 2- TR01H113[CD3]_H0_Fab-Fc(222)_IgG1_PVA_/S267K/S364K/E357Q
QVQLVESGGGVVQPGGSLRLSCAASGFTFSNAWMHWVRQAPGKGLEWVAQIKDKSQNYATYVAESVKGRFTISRADS
KNSIYLQMNSLKTEDTAVYYCRYVHYAAGYGVDIWGQGTTVTVSSASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK (SEQ ID
NO: 445)

Chain 3- GCH065[GPC3]_L0 Light Chain
DIVMTQSPLSLPVTPGEPASISCRSSQPLVHSNRNTYLHWYQQKPGQAPRLLIYKVSNRFSGVPDRFSGSGSGTDFT
LKISRVEAEDVGVYYCGQGTQVPYTFGQGTKLEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC(SEQ ID NO:
446)

Figure 23

| Affinity detuned variant (in context of 1 + 1 Fab-scFv-Fc bsAb) | Human GPC3 KD (nM) | Cyno GPC3 KD (nM) |
|---|---|---|
| XENP21971_GPC3-A_H1_L1 | 4 | 4 |
| XENP34364_GPC3-A_H1.1__L1.29 | 70 | 73 |
| XENP34365_GPC3-A_H1.1__L1.16 | 93 | 100 |
| XENP34367_GPC3-A_H1.1__L1.23 | 200 | 209 |
| XENP34368_GPC3-A_H1.1__L1.31 | 464 | 485 |

Figure 25

| XENP | GPC3-A Variant | VH Mutation (Kabat) | VL Mutation (Kabat) | KD (M) | Purpose |
|---|---|---|---|---|---|
| 21969 | H1L1 | WT | WT | 3.17E-09 | WT |
| 23060 | H1.1_L1 | D52E | WT | 3.92E-09 | Remove aspartic isomerization liability |
| 23061 | H1.2_L1 | D52N | WT | 5.81E-09 | Remove aspartic isomerization liability |
| 23062 | H1.3_L1 | D52Q | WT | 3.13E-09 | Remove aspartic isomerization liability |
| 23063 | H1.4_L1 | D52S | WT | 3.62E-09 | Remove aspartic isomerization liability |
| 23064 | H1_L1.1 | WT | N28Q | 2.82E-08 | Remove deamidation liability |
| 23065 | H1_L1.2 | WT | N28Y | 7.43E-09 | Remove deamidation liability |
| 23066 | H1_L1.3 | WT | N28S | 1.27E-08 | Remove deamidation liability |
| 23067 | H1_L1.4 | WT | N28H | 1.17E-08 | Remove deamidation liability |
| 23068 | H1_L1.5 | WT | G29A | 2.09E-09 | Remove deamidation liability |
| 23069 | H1_L1.6 | WT | G29T | 2.85E-09 | Remove deamidation liability |
| 23070 | H1_L1.7 | WT | G29K | 2.22E-09 | Remove deamidation liability |
| 23071 | H1_L1.8 | WT | N30Q | 2.35E-09 | Remove deamidation liability |
| 23072 | H1_L1.9 | WT | N30Y | 1.37E-09 | Remove deamidation liability |
| 23073 | H1_L1.10 | WT | N30H | 3.38E-09 | Remove deamidation liability |

Figure 26

| XENP | GPC3-A Variant | VL Mutation (Kabat) | Human GPC3 KD (nM) | Cyno GPC3 KD (nM) |
|---|---|---|---|---|
| XENP36931 | H1.1_L1.65 | N28Y Y32W | biphasic binding, unreliable fit | |
| XENP36932 | H1.1_L1.66 | G29A Y32W | biphasic binding, unreliable fit | |
| XENP36933 | H1.1_L1.67 | G29K Y32W | 550 nM | 600 nM |
| XENP36934 | H1.1_L1.68 | N28Y K50Q | 370 nM | 370 nM |
| XENP36935 | H1.1_L1.69 | G29A K50Q | 150 nM | 150 nM |
| XENP36936 | H1.1_L1.70 | G29K K50Q | 130 nM | 130 nM |
| XENP36937 | H1.1_L1.71 | N28Y K50Y | low response | |
| XENP36938 | H1.1_L1.72 | G29A K50Y | biphasic binding, unreliable fit | |
| XENP36939 | H1.1_L1.73 | G29K K50Y | 477 nM | 550 nM |

Figure 27
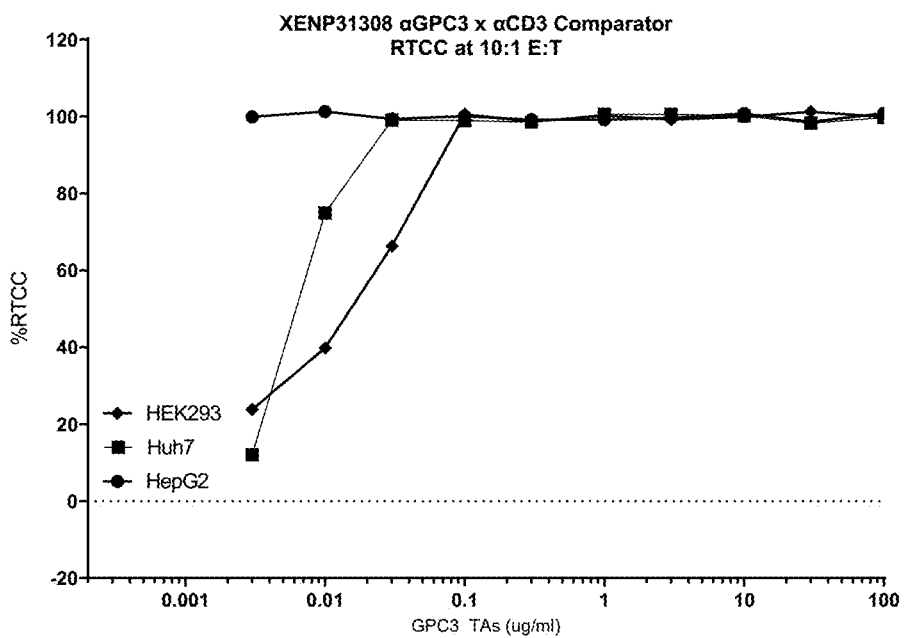
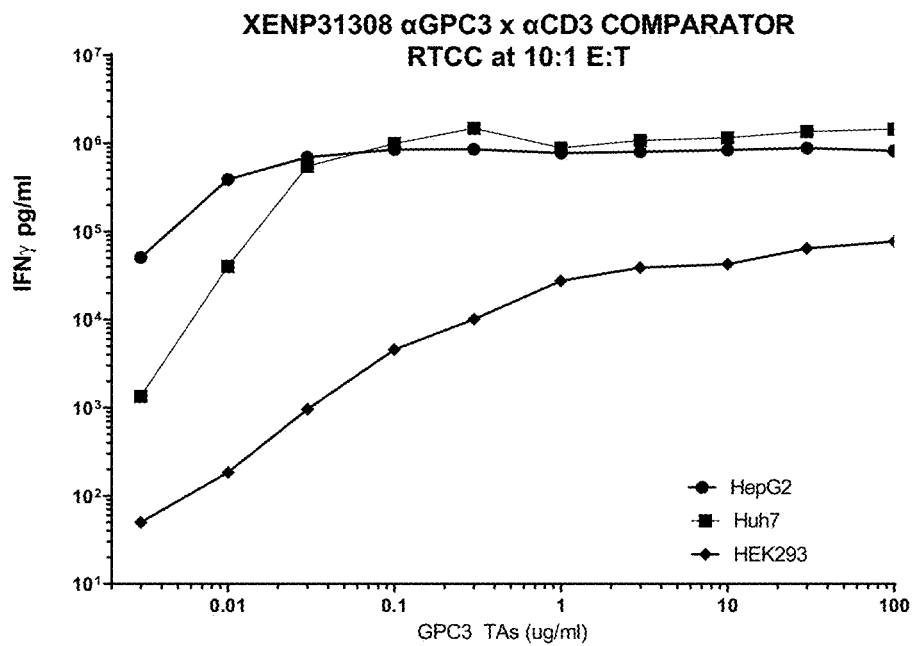

Figure 28
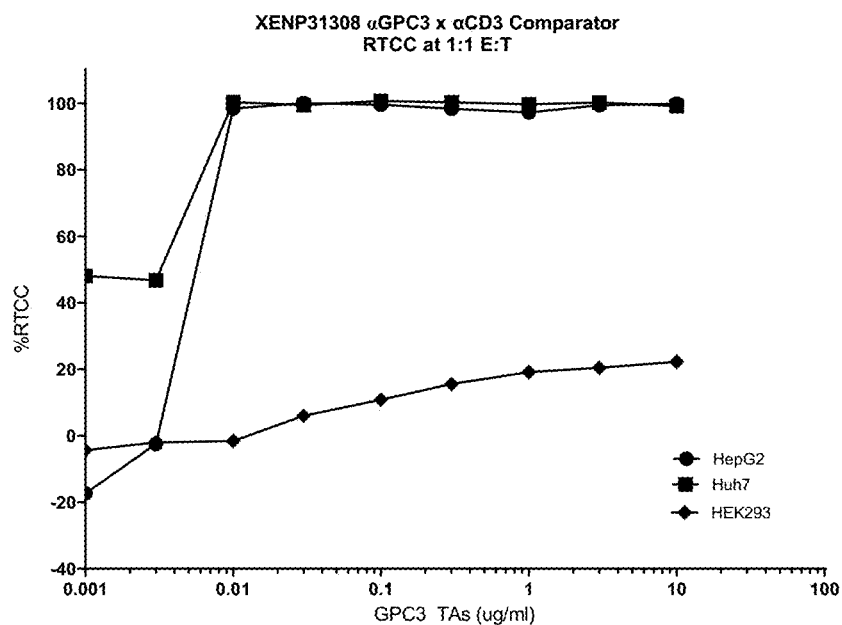
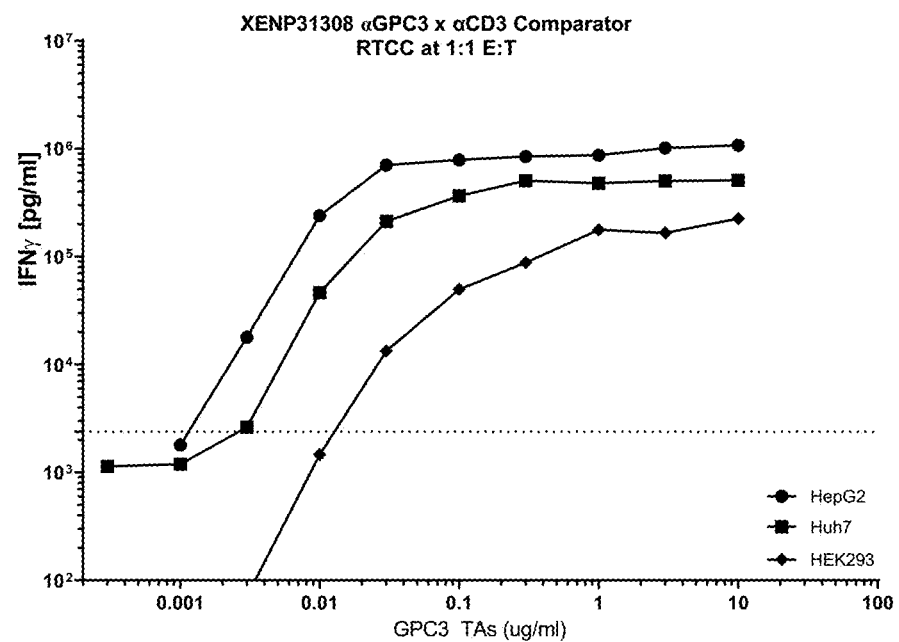

Figure 30
A)
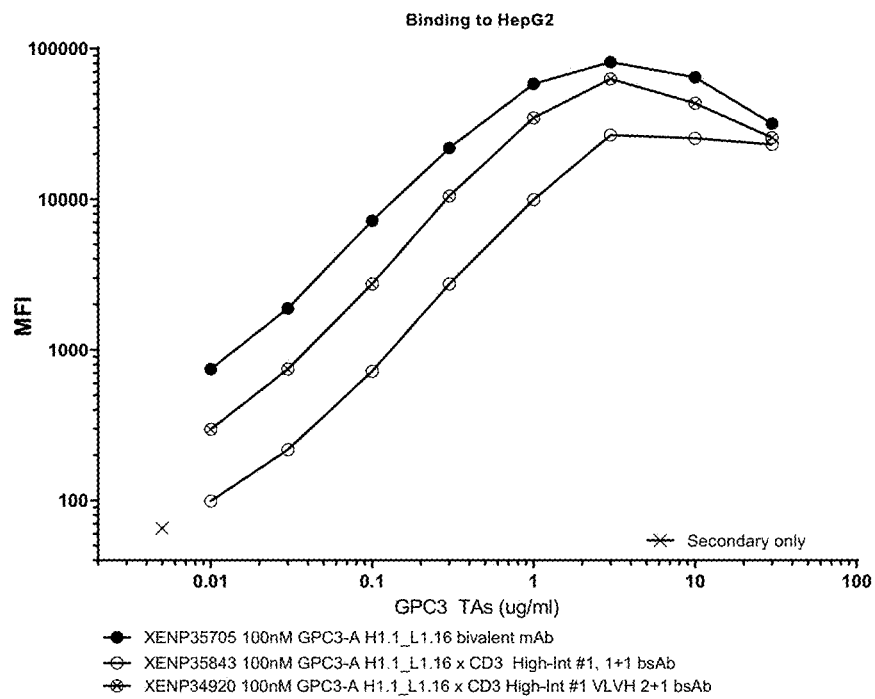
B)
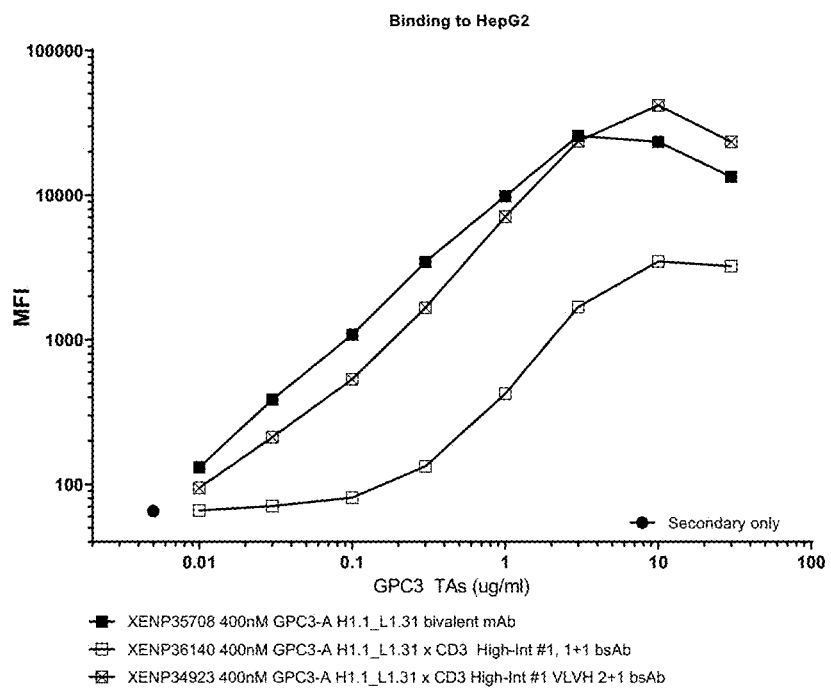

Figure 31
A)
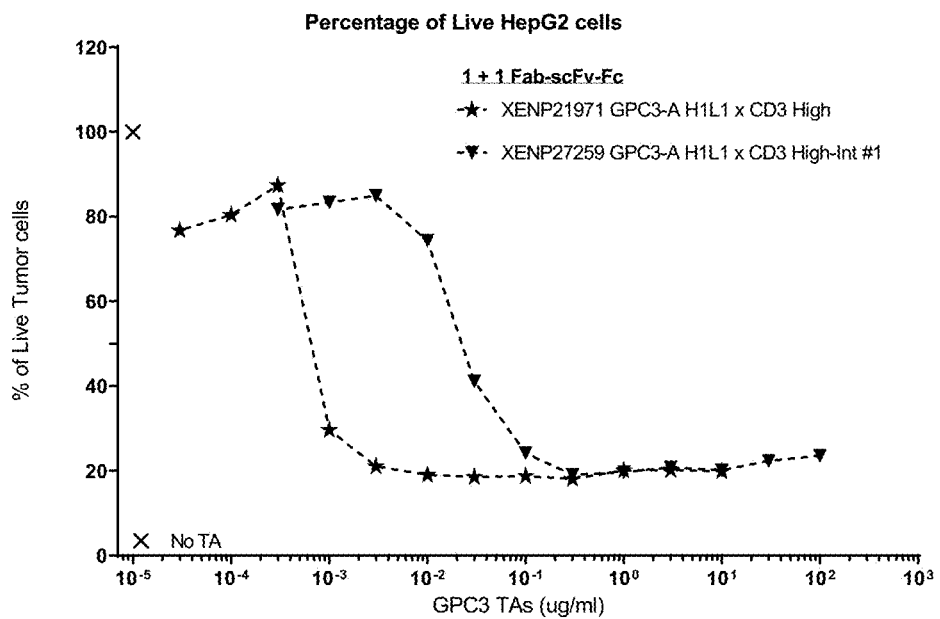
B)
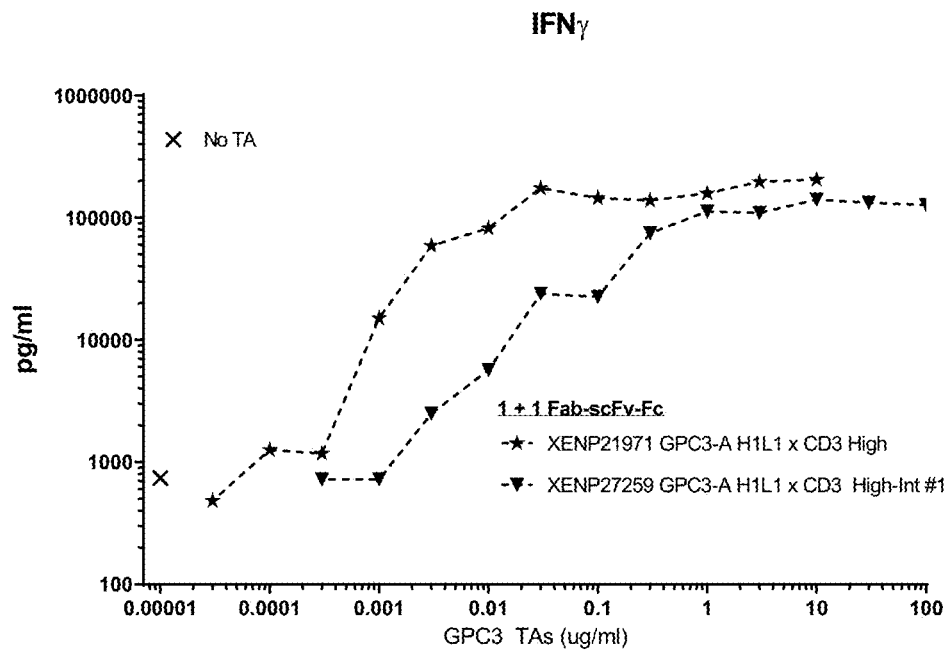

Figure 32
A)
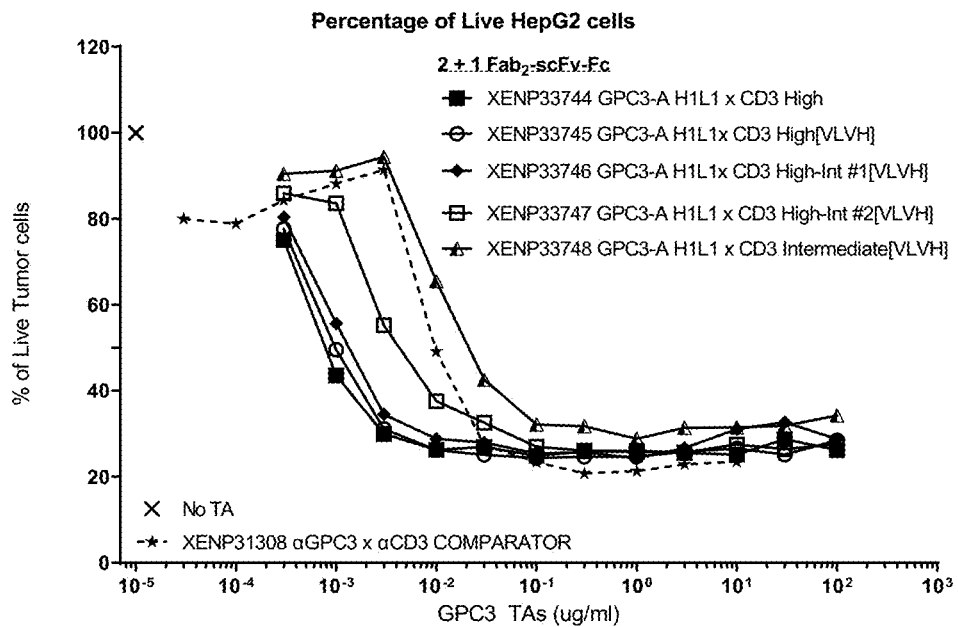
B)
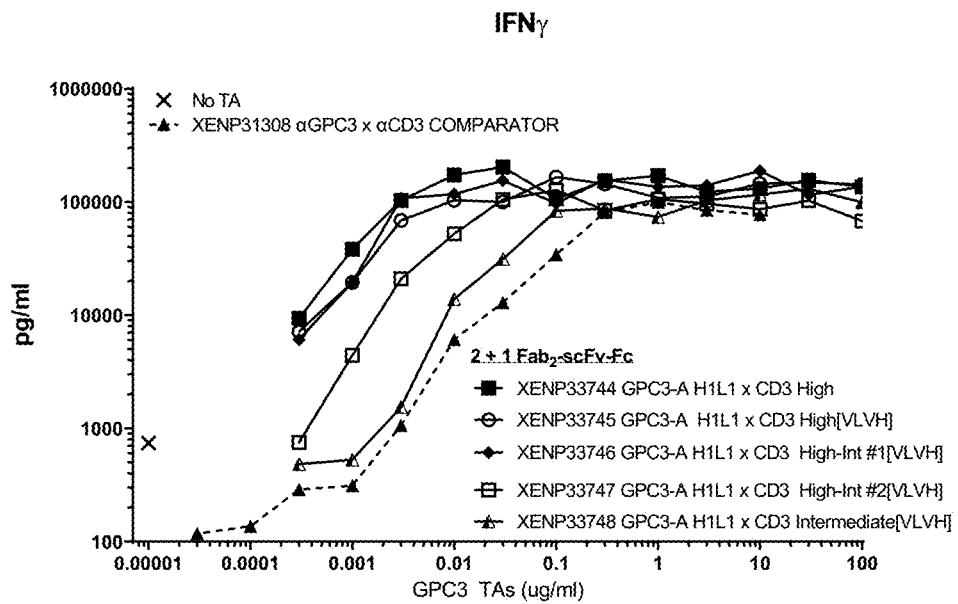

Figure 33
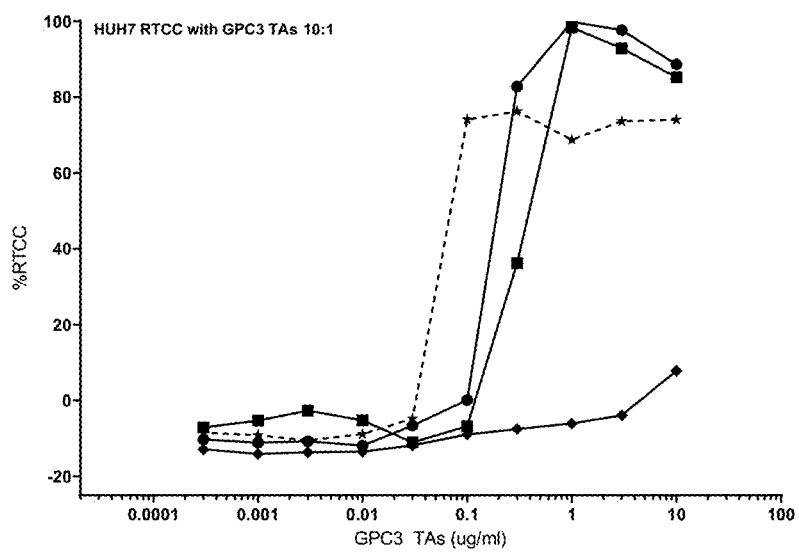
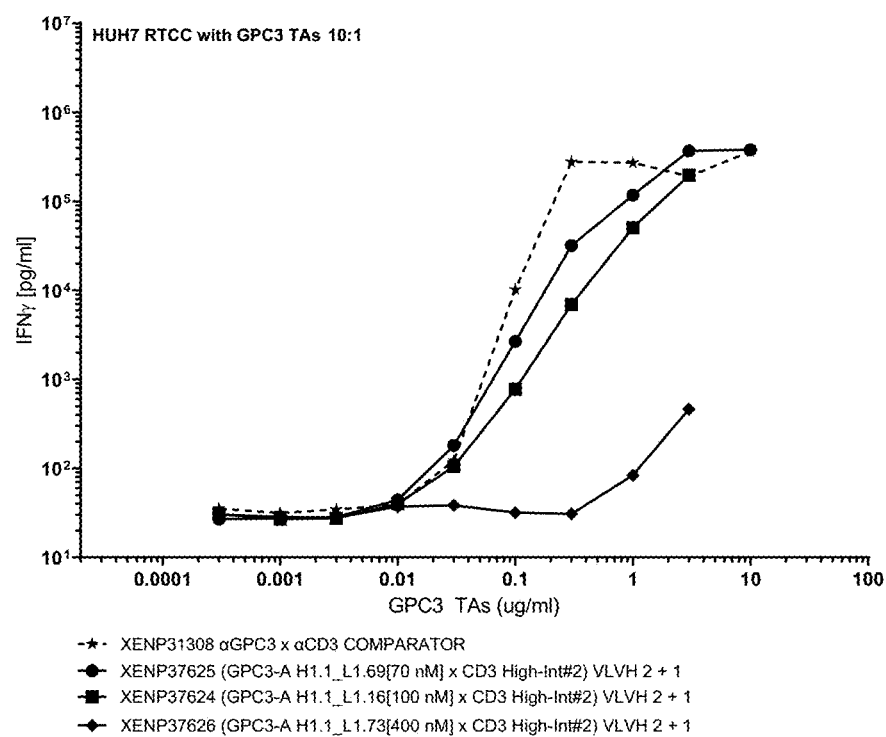
- ★ - XENP31308 αGPC3 x αCD3 COMPARATOR
- ● - XENP37625 (GPC3-A H1.1_L1.69[70 nM] x CD3 High-Int#2) VLVH 2 + 1
- ■ - XENP37624 (GPC3-A H1.1_L1.16[100 nM] x CD3 High-Int#2) VLVH 2 + 1
- ◆ - XENP37626 (GPC3-A H1.1_L1.73[400 nM] x CD3 High-Int#2) VLVH 2 + 1

Figure 34
A)
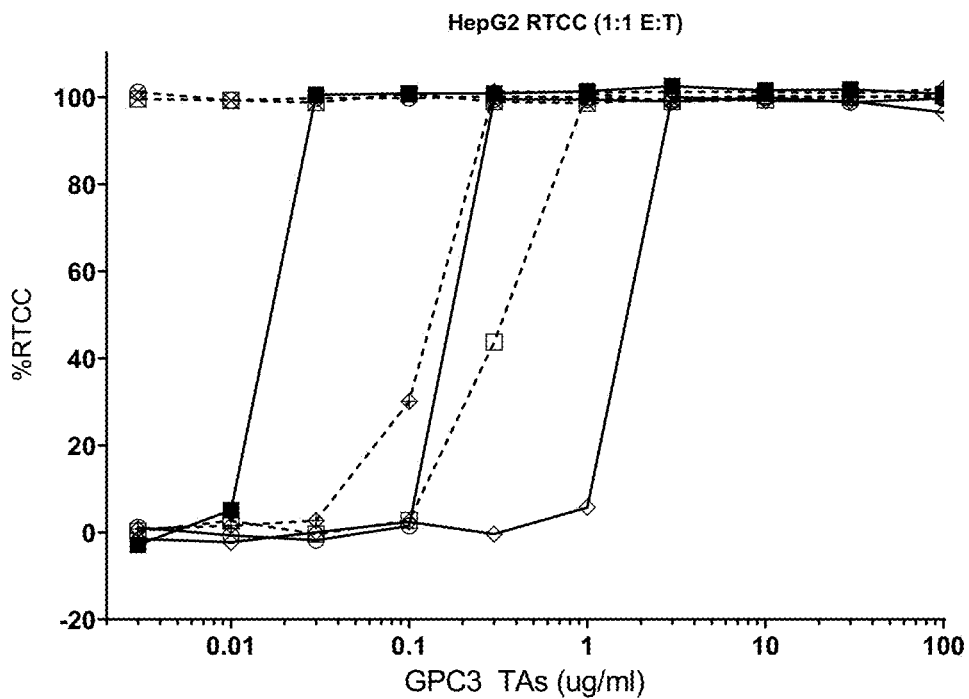
B)
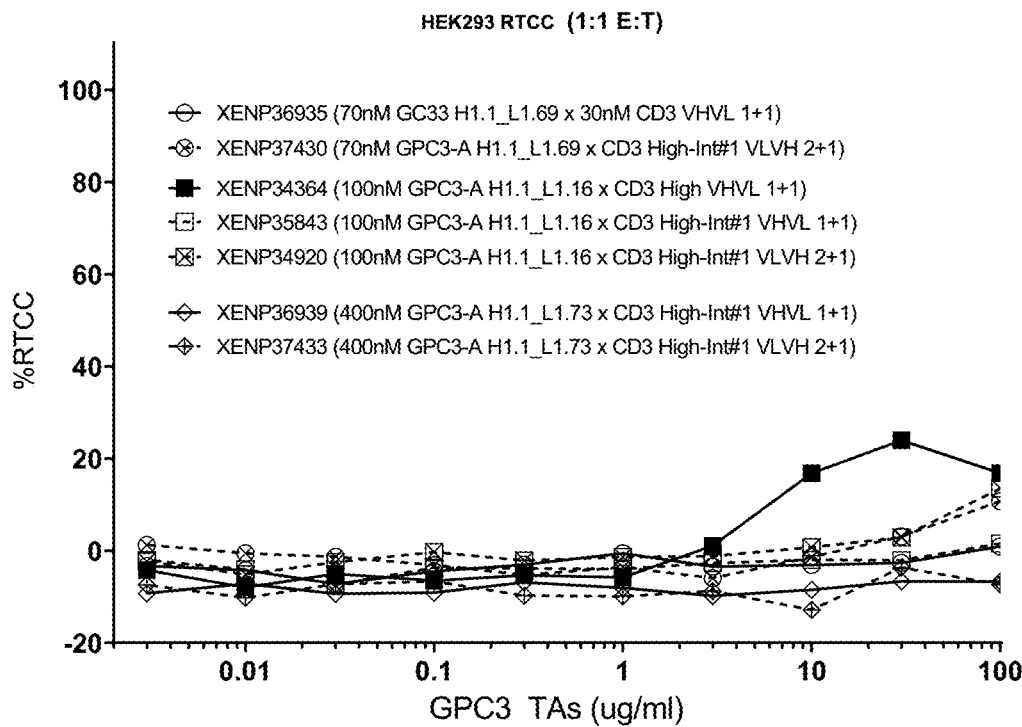

Figure 35
A)
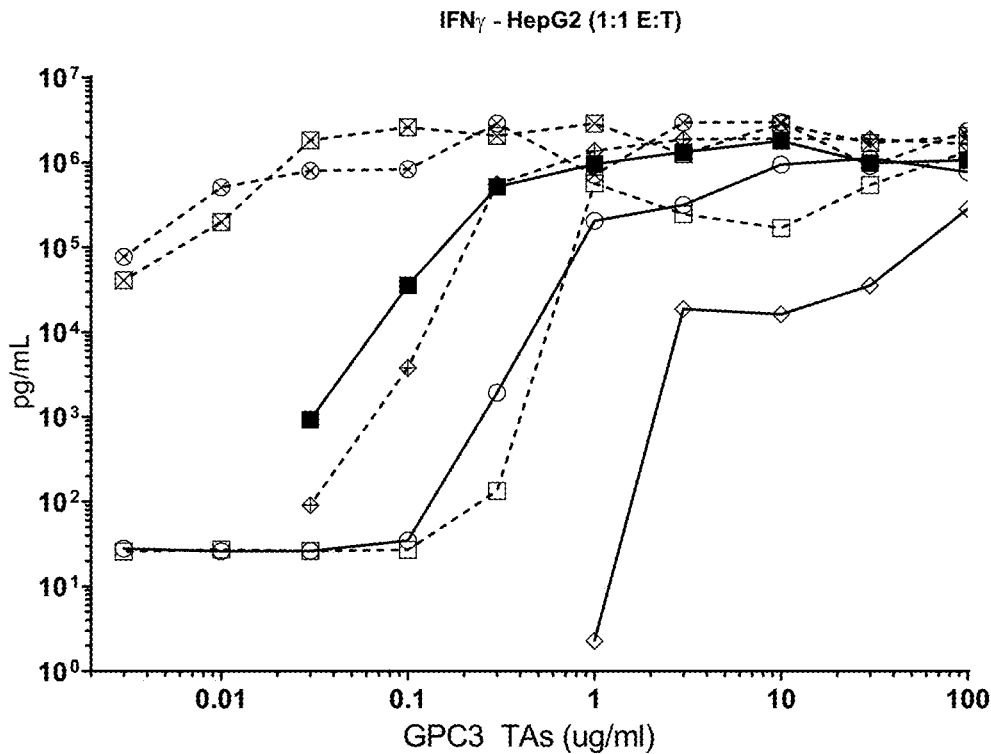
B)
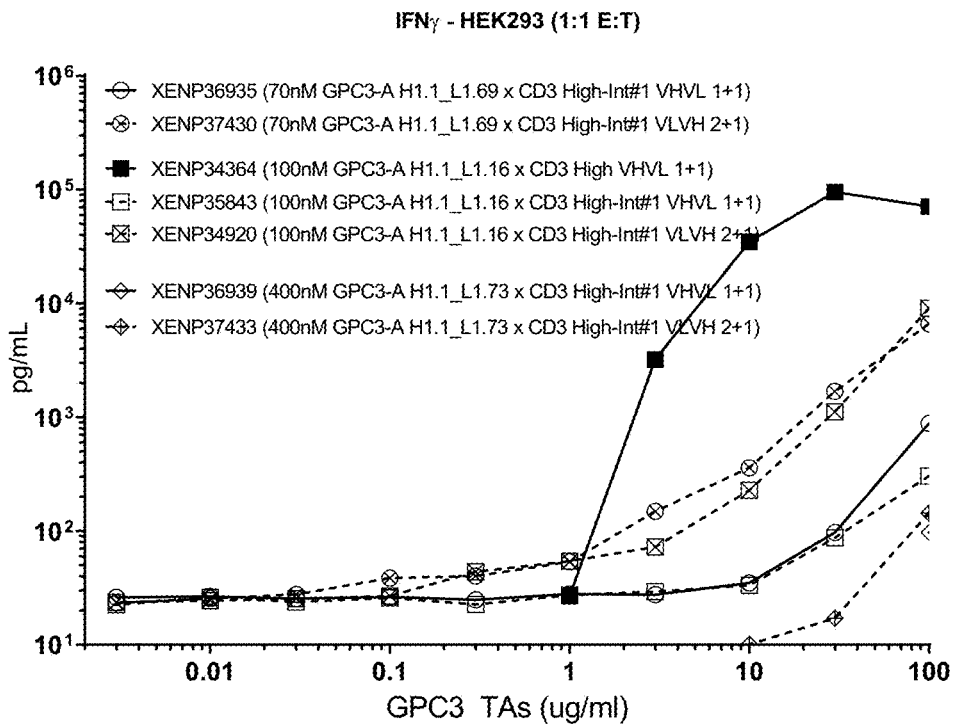

Figure 36

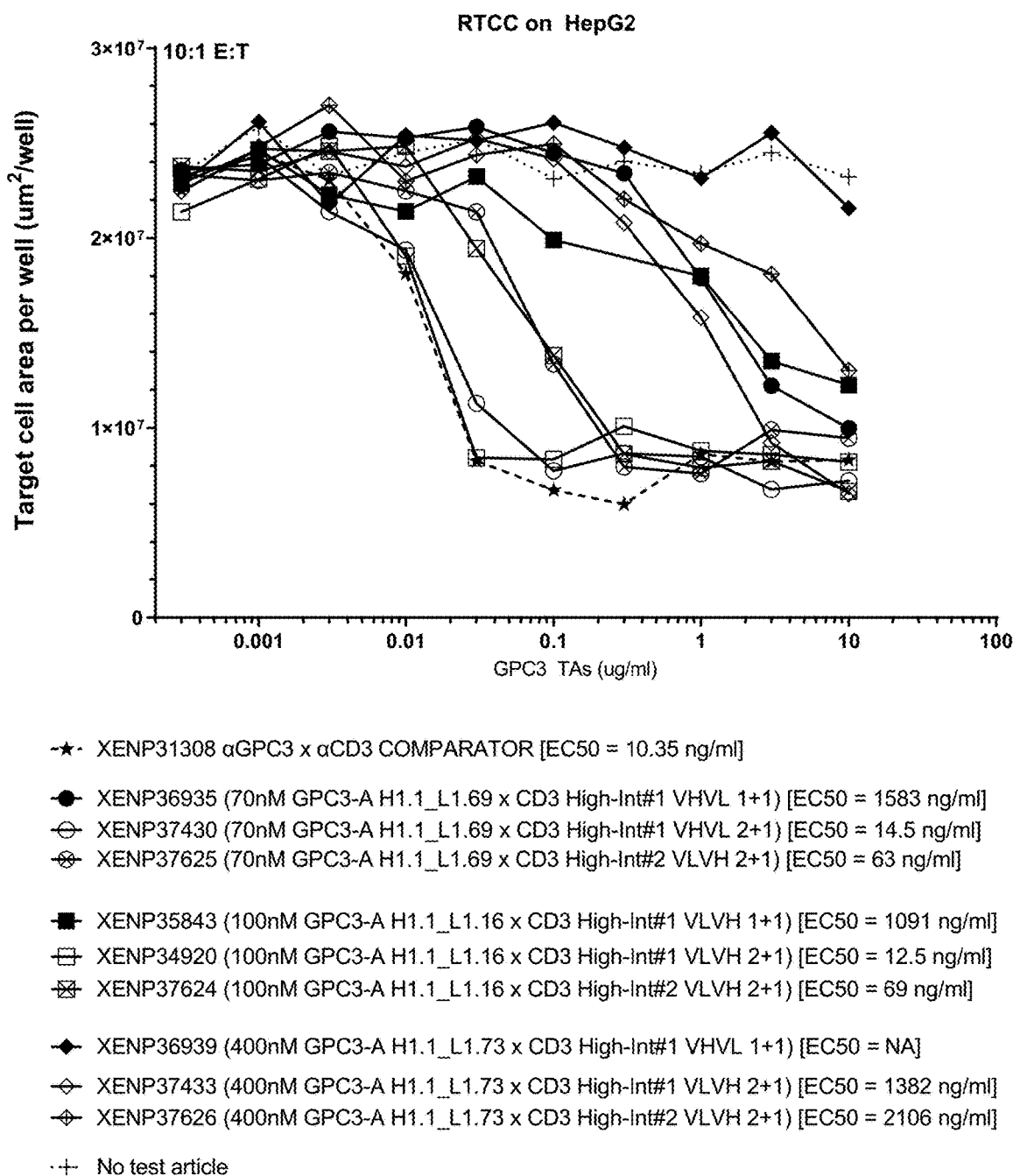

-★- XENP31308 αGPC3 x αCD3 COMPARATOR [EC50 = 10.35 ng/ml]

-●- XENP36935 (70nM GPC3-A H1.1_L1.69 x CD3 High-Int#1 VHVL 1+1) [EC50 = 1583 ng/ml]
-○- XENP37430 (70nM GPC3-A H1.1_L1.69 x CD3 High-Int#1 VHVL 2+1) [EC50 = 14.5 ng/ml]
-⊗- XENP37625 (70nM GPC3-A H1.1_L1.69 x CD3 High-Int#2 VLVH 2+1) [EC50 = 63 ng/ml]

-■- XENP35843 (100nM GPC3-A H1.1_L1.16 x CD3 High-Int#1 VLVH 1+1) [EC50 = 1091 ng/ml]
-⊟- XENP34920 (100nM GPC3-A H1.1_L1.16 x CD3 High-Int#1 VLVH 2+1) [EC50 = 12.5 ng/ml]
-⊠- XENP37624 (100nM GPC3-A H1.1_L1.16 x CD3 High-Int#2 VLVH 2+1) [EC50 = 69 ng/ml]

-◆- XENP36939 (400nM GPC3-A H1.1_L1.73 x CD3 High-Int#1 VHVL 1+1) [EC50 = NA]
-◇- XENP37433 (400nM GPC3-A H1.1_L1.73 x CD3 High-Int#1 VHVL 2+1) [EC50 = 1382 ng/ml]
-◈- XENP37626 (400nM GPC3-A H1.1_L1.73 x CD3 High-Int#2 VLVH 2+1) [EC50 = 2106 ng/ml]

··+·· No test article

Bottle Opener or
1+1 Fab-scFv-Fc

Dual scFv

One-arm central-scFv

One-arm scFv-mAb scFv-mAb

Central scFv or
2+1 Fab2-scFv-Fc mAb-Fv mAb-scFv central-Fv

Bispecific mAb

HETERODIMERIC ANTIBODIES THAT BIND CD3 AND GPC3

PRIORITY CLAIM

This application claims the benefit of U.S. Provisional Patent Application Nos. 63/159,058, filed Mar. 10, 2021, and 63/173,127, filed Apr. 9, 2021, which are hereby incorporated by reference in their entirety.

SEQUENCE LISTING

The instant application contains a Sequence Listing which has been submitted electronically in ASCII format and is hereby incorporated by reference in its entirety. Said ASCII copy, created on Feb. 28, 2022, is named 067461-5282-WO_SL.txt and is 853,417 bytes in size.

SUMMARY

Provided herein are novel GPC3 binding domains, and antibodies that include such GPC3 binding domains (e.g., anti-GPC3×anti-CD3). Also provided herein are methods of using such antibodies for the treatment of GPC3-associated cancers.

In a first aspect, provided herein is a composition comprising a GPC3 antigen binding domain (ABD). The GPC3 binding domain comprises a set of 6 CDRs (vhCDR1, vhCDR2, vhCDR3, vlCDR1, vlCDR2 and vlCDR3) from a variable heavy domain (VH)/variable light domain (VL) pair selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10, [GPC3]H1.1_L1.16, [GPC3]H1.1_L1.23, [GPC3]H1.1_L1.29, [GPC3]H1.1_L1.31, [GPC3]H1.1_L1.65, [GPC3]H1.1_L1.66, L1.67, [GPC3]H1.1_L1.68, [GPC3]H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3]H1.2_L1.29, [GPC3]H1.2_L1.31, [GPC3]H1.2_L1.65, [GPC3]H1.2_L1.66, [GPC3]H1.2_L1.67, [GPC3]H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]H1.3_L1.2, [GPC3]H1.3_L1.3, [GPC3]H1.3_L1.4, [GPC3]H1.3_L1.5, [GPC3]H1.3_L1.6, [GPC3]H1.3_L1.7, [GPC3]H1.3_L1.8, [GPC3]H1.3_L1.9, [GPC3]H1.3_L1.10, [GPC3]H1.3_L1.16, [GPC3]H1.3_L1.23, [GPC3]H1.3_L1.29, [GPC3]H1.3_L1.31, [GPC3]H1.3_L1.65, [GPC3]H1.3_L1.66, [GPC3]H1.3_L1.67, [GPC3]H1.3_L1.68, [GPC3]H1.3_L1.70, [GPC3]H1.3_L1.71, [GPC3]H1.3_L1.72, [GPC3]H1.3_L1.73, [GPC3]H1.4_L1, [GPC3]H1.4_L1.1, [GPC3]H1.4_L1.2, [GPC3]H1.4_L1.3, [GPC3]H1.4_L1.4, [GPC3]H1.4_L1.5, [GPC3]H1.4_L1.6, [GPC3]H1.4_L1.7, [GPC3]H1.4_L1.8, [GPC3]H1.4_L1.9, [GPC3]H1.4_L1.10, [GPC3]H1.4_L1.16, [GPC3]H1.4_L1.23, [GPC3]H1.4_L1.29, [GPC3]H1.4_L1.31, [GPC3]H1.4_L1.65, [GPC3]H1.4_L1.66, [GPC3]H1.4_L1.67, [GPC3]H1.4_L1.68, [GPC3]H1.4_L1.70, [GPC3]H1.4_L1.71, [GPC3]H1.4_L1.72 and [GPC3]H1.4_L1.73.

In some embodiments, the ABD has a VH/VL pair selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10, [GPC3]H1.1_L1.16, [GPC3]H1.1_L1.23, [GPC3]H1.1_L1.29, [GPC3]H1.1_L1.31, [GPC3]H1.1_L1.65, [GPC3]H1.1_L1.66, L1.67, [GPC3]H1.1_L1.68, [GPC3]H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3]H1.2_L1.29, [GPC3]H1.2_L1.31, [GPC3]H1.2_L1.65, [GPC3]H1.2_L1.66, [GPC3]H1.2_L1.67, [GPC3]H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]H1.3_L1.2, [GPC3]H1.3_L1.3, [GPC3]H1.3_L1.4, [GPC3]H1.3_L1.5, [GPC3]H1.3_L1.6, [GPC3]H1.3_L1.7, [GPC3]H1.3_L1.8, [GPC3]H1.3_L1.9, [GPC3]H1.3_L1.10, [GPC3]H1.3_L1.16, [GPC3]H1.3_L1.23, [GPC3]H1.3_L1.29, [GPC3]H1.3_L1.31, [GPC3]H1.3_L1.65, [GPC3]H1.3_L1.66, [GPC3]H1.3_L1.67, [GPC3]H1.3_L1.68, [GPC3]H1.3_L1.70, [GPC3]H1.3_L1.71, [GPC3]H1.3_L1.72, [GPC3]H1.3_L1.73, [GPC3]H1.4_L1, [GPC3]H1.4_L1.1, [GPC3]H1.4_L1.2, [GPC3]H1.4_L1.3, [GPC3]H1.4_L1.4, [GPC3]H1.4_L1.5, [GPC3]H1.4_L1.6, [GPC3]H1.4_L1.7, [GPC3]H1.4_L1.8, [GPC3]H1.4_L1.9, [GPC3]H1.4_L1.10, [GPC3]H1.4_L1.16, [GPC3]H1.4_L1.23, [GPC3]H1.4_L1.29, [GPC3]H1.4_L1.31, [GPC3]H1.4_L1.65, [GPC3]H1.4_L1.66, [GPC3]H1.4_L1.67, [GPC3]H1.4_L1.68, [GPC3]H1.4_L1.70, [GPC3]H1.4_L1.71, [GPC3]H1.4_L1.72 and [GPC3]H1.4_L1.73.

In some embodiments, the VH/VL pair is selected from the group consisting of [GPC3]H1.1_L1.16 and [GPC3]H1.1_L1.69. In exemplary embodiments, the composition is a monoclonal antibody.

In another aspect, provided herein is a heterodimeric antibody comprising: a) a first monomer, b) a second monomer, and c) a light chain. The first monomer comprises: i) an anti-CD3 scFv comprising a first variable light domain, an scFv linker and a first variable heavy domain; and ii) a first Fc domain, wherein the scFv is covalently attached to the N-terminus of the first Fc domain using a domain linker. The second monomer comprises a VH2-CH1-hinge-CH2-CH3 monomer, wherein VH is a second variable heavy domain and CH2-CH3 is a second Fc domain. In this embodiment, the second variable heavy domain and the second variable light domain form a GPC3 antigen binding domain (ABD).

In some embodiments, the GPC3 binding domain comprises a set of 6 CDRs (vhCDR1, vhCDR2, vhCDR3, vlCDR1, vlCDR2 and vlCDR3) from a VH/VL pair selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10, [GPC3]H1.1_L1.16, [GPC3]H1.1_L1.23, [GPC3]H1.1_L1.29, [GPC3]H1.1_L1.31, [GPC3]H1.1_L1.65, [GPC3]H1.1_L1.66, L1.67, [GPC3]H1.1_L1.68, [GPC3]H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3]H1.2_L1.29, [GPC3]H1.2_L1.31, [GPC3]H1.2_L1.65, [GPC3]H1.2_L1.66, [GPC3]H1.2_L1.67, [GPC3]H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]H1.3_L1.2, [GPC3]H1.3_L1.3, [GPC3]H1.3_L1.4, [GPC3]H1.3_L1.5, [GPC3]H1.3_L1.6, [GPC3]H1.3_L1.7, [GPC3]H1.3_L1.8, [GPC3]H1.3_L1.9, [GPC3]H1.3_L1.10, [GPC3]H1.3_L1.16, [GPC3]H1.3_L1.23, [GPC3]H1.3_L1.29, [GPC3]H1.3_L1.31, [GPC3]H1.3_L1.65, [GPC3]H1.3_L1.66, [GPC3]H1.3_L1.67, [GPC3]H1.3_L1.68, [GPC3]H1.3_L1.70, [GPC3]H1.3_L1.71, [GPC3]H1.3_L1.72, [GPC3]H1.3_L1.73, [GPC3]H1.4_L1, [GPC3]H1.4_L1.1, [GPC3]H1.4_L1.2, [GPC3]H1.4_L1.3, [GPC3]H1.4_L1.4, [GPC3]H1.4_L1.5, [GPC3]H1.4_L1.6, [GPC3]H1.4_L1.7, [GPC3]H1.4_L1.8, [GPC3]H1.4_L1.9, [GPC3]H1.4_L1.10, [GPC3]H1.4_L1.16, [GPC3]H1.4_L1.23, [GPC3]H1.4_L1.29, [GPC3]H1.4_L1.31, [GPC3]H1.4_L1.65, [GPC3]H1.4_L1.66, [GPC3]H1.4_L1.67, [GPC3]H1.4_L1.68, [GPC3]H1.4_L1.70, [GPC3]H1.4_L1.71, [GPC3]H1.4_L1.72 and [GPC3]H1.4_L1.73.

In exemplary embodiments, the GPC3 binding domain comprises a VH/VL pair selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10, [GPC3]H1.1_L1.16, [GPC3]H1.1_L1.23, [GPC3]H1.1_L1.29, [GPC3]H1.1_L1.31, [GPC3]H1.1_L1.65, [GPC3]H1.1_L1.66, L1.67, [GPC3]H1.1_L1.68, [GPC3]H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3]H1.2_L1.29, [GPC3]H1.2_L1.31, [GPC3]H1.2_L1.65, [GPC3]H1.2_L1.66, [GPC3]H1.2_L1.67, [GPC3]H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]H1.3_L1.2, [GPC3]H1.3_L1.3, [GPC3]H1.3_L1.4, [GPC3]H1.3_L1.5, [GPC3]H1.3_L1.6, [GPC3]H1.3_L1.7, [GPC3]H1.3_L1.8, [GPC3]H1.3_L1.9, [GPC3]H1.3_L1.10, [GPC3]H1.3_L1.16, [GPC3]H1.3_L1.23, [GPC3]H1.3_L1.29, [GPC3]H1.3_L1.31, [GPC3]H1.3_L1.65, [GPC3]H1.3_L1.66, [GPC3]H1.3_L1.67, [GPC3]H1.3_L1.68, [GPC3]H1.3_L1.70, [GPC3]H1.3_L1.71, [GPC3]H1.3_L1.72, [GPC3]H1.3_L1.73, [GPC3]H1.4_L1, [GPC3]H1.4_L1.1, [GPC3]H1.4_L1.2, [GPC3]H1.4_L1.3, [GPC3]H1.4_L1.4, [GPC3]H1.4_L1.5, [GPC3]H1.4_L1.6, [GPC3]H1.4_L1.7, [GPC3]H1.4_L1.8, [GPC3]H1.4_L1.9, [GPC3]H1.4_L1.10, [GPC3]H1.4_L1.16, [GPC3]H1.4_L1.23, [GPC3]H1.4_L1.29, [GPC3]H1.4_L1.31, [GPC3]H1.4_L1.65, [GPC3]H1.4_L1.66, [GPC3]H1.4_L1.67, [GPC3]H1.4_L1.68, [GPC3]H1.4_L1.70, [GPC3]H1.4_L1.71, [GPC3]H1.4_L1.72 and [GPC3]H1.4_L1.73.

In exemplary embodiments, the GPC3 binding domain comprises a VH/VL pair selected from the group consisting of: [GPC3]H1.1_L1.16 and [GPC3]H1.1_L1.69.

In some embodiments, the anti-CD3 scFv comprises a VH and VL pair selected from the group consisting of: H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31.

In some embodiments of the heterodimeric antibody, the scFv linker is a charged scFv linker.

In some embodiments, the first and second Fc domains are variant Fc domains. In some embodiments, the first and second Fc domains comprise a set of heterodimerization variants selected from the group consisting of those depicted in FIGS. 1A-1E. In some embodiments, the set of heterodimerization variants selected is from the group consisting of S364K/E357Q: L368D/K370S; S364K: L368D/K370S; S364K: L368E/K370S; D401K: T411E/K360E/Q362E; and T366W: T366S/L368A/Y407V, wherein numbering is according to EU numbering.

In some embodiments, the first and second monomers further comprise one or more ablation variants. In some embodiments, the one or more ablation variants are E233P/L234V/L235A/G236del/S267K, wherein numbering is according to EU numbering.

In exemplary embodiments, one of the first or second monomer comprises one or more pI variants. In some embodiments, the one or more pI variants are N208D/Q295E/N384D/Q418E/N421D, wherein numbering is according to EU numbering.

In exemplary embodiments of the heterodimeric antibody, the first monomer comprises amino acid variants S364K/E357Q/E233P/L234V/L235A/G236del/S267K, the second monomer comprises amino acid variants L368D/K370S/N208D/Q295E/N384D/Q418E/N421D/E233P/L234V/L235A/G236del/S267K, and wherein numbering is according to EU numbering.

In some embodiments, the first and second monomers each further comprise amino acid variants 428/434S, wherein numbering is according to EU numbering.

In another aspect, provided herein is a heterodimeric antibody comprising: a) a first monomer comprising, from N-terminal to C-terminal, a scFv-linker-CH2-CH3, wherein scFv is an anti-CD3 scFv and CH2-CH3 is a first Fc domain; b) a second monomer comprising, from N-terminal to C-terminal, a VH-CH1-hinge-CH2-CH3, wherein CH2-CH3 is a second Fc domain; and c) a light chain comprising VL-CL.

The first variant Fc domain comprises amino acid variants S364K/E357Q, the second variant Fc domain comprises amino acid variants L368D/K370S, the first and second variant Fc domains each comprises amino acid variants E233P/L234V/L235A/G236del/S267K, and the CH1-hinge-CH2-CH3 of the second monomer comprises amino acid variants N208D/Q295E/N384D/Q418E/N421D (EU numbering). Further, the VH and VL form an GPC3 binding domain comprising the variable heavy domain and the variable light domain, respectively, of a GPC3 binding domain selected from [GPC3]H1.1_L1.16 and [GPC3]H1.1_L1.69; and the anti-CD3 scFv comprises the variable heavy domain and the variable light domain of a CD3 binding domain selected from H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31.

In some embodiments, the first and second variant Fc domains each further comprise amino acid variants 428/434S, wherein numbering is according to EU numbering.

In another aspect, provided herein is a heterodimeric antibody comprising: a) a first monomer, b) a second monomer, and c) a common light chain. The first monomer comprises, from N-terminal to C-terminal, a VH1-CH1-linker 1-scFv-linker 2-CH2-CH3, wherein VH1 is a first variable heavy domain, scFv is an anti-CD3 scFv, linker 1 and linker 2 are a first domain linker and second domain linker, respectively, and CH2-CH3 is a first Fc domain. The second monomer comprises, from N-terminal to C-terminal, a VH2-CH1-hinge-CH2-CH3, wherein VH2 is a second variable heavy domain and CH2-CH3 is a second Fc domain; and c) a common light chain comprising a variable light domain. The first variable heavy domain and the variable light domain form a first CLDN6 ABD, and the second variable heavy domain and the variable light domain form a second CLDN6 ABD.

In another aspect, provided herein is a heterodimeric antibody comprising: a) a first monomer, b) a second monomer, and c) a common light chain. The first monomer comprises, from N-terminal to C-terminal, a VH1-CH1-linker 1-scFv-linker 2-CH2-CH3, wherein VH1 is a first variable heavy domain, scFv is an anti-CD3 scFv, linker 1 and linker 2 are a first domain linker and second domain linker, respectively, and CH2-CH3 is a first Fc domain. The second monomer comprises, from N-terminal to C-terminal, a VH2-CH1-hinge-CH2-CH3, wherein VH2 is a second variable heavy domain and CH2-CH3 is a second Fc domain; and c) a common light chain comprising a variable light domain. The first variable heavy domain and the variable light domain form a first GPC3 ABD, and the second variable heavy domain and the variable light domain form a second GPC3 ABD.

In some embodiments, the first and second GPC3 binding domains each comprise a set of 6 CDRs (vhCDR1, vhCDR2, vhCDR3, vlCDR1, vlCDR2 and vlCDR3) from a VH/VL pair selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10, [GPC3]H1.1_L1.16, [GPC3]H1.1_L1.23, [GPC3]H1.1_L1.29, [GPC3]H1.1_L1.31, [GPC3]H1.1_L1.65, [GPC3]H1.1_L1.66, L1.67, [GPC3]H1.1_L1.68, [GPC3]H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3]H1.2_L1.29, [GPC3]H1.2_L1.31, [GPC3]H1.2_L1.65, [GPC3]H1.2_L1.66, [GPC3]H1.2_L1.67, [GPC3]H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]H1.3_L1.2, [GPC3]H1.3_L1.3, [GPC3]H1.3_L1.4, [GPC3]H1.3_L1.5, [GPC3]H1.3_L1.6, [GPC3]H1.3_L1.7, [GPC3]H1.3_L1.8, [GPC3]H1.3_L1.9, [GPC3]H1.3_L1.10, [GPC3]H1.3_L1.16, [GPC3]H1.3_L1.23, [GPC3]H1.3_L1.29, [GPC3]H1.3_L1.31, [GPC3]H1.3_L1.65, [GPC3]H1.3_L1.66, [GPC3]H1.3_L1.67, [GPC3]H1.3_L1.68, [GPC3]H1.3_L1.70, [GPC3]H1.3_L1.71, [GPC3]H1.3_L1.72, [GPC3]H1.3_L1.73, [GPC3]H1.4_L1, [GPC3]H1.4_L1.1, [GPC3]H1.4_L1.2, [GPC3]H1.4_L1.3, [GPC3]H1.4_L1.4, [GPC3]H1.4_L1.5, [GPC3]H1.4_L1.6, [GPC3]H1.4_L1.7, [GPC3]H1.4_L1.8, [GPC3]H1.4_L1.9, [GPC3]H1.4_L1.10, [GPC3]H1.4_L1.16, [GPC3]H1.4_L1.23, [GPC3]H1.4_L1.29, [GPC3]H1.4_L1.31, [GPC3]H1.4_L1.65, [GPC3]H1.4_L1.66, [GPC3]H1.4_L1.67, [GPC3]H1.4_L1.68, [GPC3]H1.4_L1.70, [GPC3]H1.4_L1.71, [GPC3]H1.4_L1.72 and [GPC3]H1.4_L1.73.

In some embodiments, each of the first and second GPC3 binding domains have a VH/VL pair selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10, [GPC3]H1.1_L1.16, [GPC3]H1.1_L1.23, [GPC3]H1.1_L1.29, [GPC3]H1.1_L1.31, [GPC3]H1.1_L1.65, [GPC3]H1.1_L1.66, L1.67, [GPC3]H1.1_L1.68, [GPC3]H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3]H1.2_L1.29, [GPC3]H1.2_L1.31, [GPC3]H1.2_L1.65, [GPC3]H1.2_L1.66, [GPC3]H1.2_L1.67, [GPC3]H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]H1.3_L1.2, [GPC3]H1.3_L1.3, [GPC3]H1.3_L1.4, [GPC3]H1.3_L1.5, [GPC3]H1.3_L1.6, [GPC3]H1.3_L1.7, [GPC3]H1.3_L1.8, [GPC3]H1.3_L1.9, [GPC3]H1.3_L1.10, [GPC3]H1.3_L1.16, [GPC3]H1.3_L1.23, [GPC3]H1.3_L1.29, [GPC3]H1.3_L1.31, [GPC3]H1.3_L1.65, [GPC3]H1.3_L1.66, [GPC3]H1.3_L1.67, [GPC3]H1.3_L1.68, [GPC3]H1.3_L1.70, [GPC3]H1.3_L1.71, [GPC3]H1.3_L1.72, [GPC3]H1.3_L1.73, [GPC3]H1.4_L1, [GPC3]H1.4_L1.1, [GPC3]H1.4_L1.2, [GPC3]H1.4_L1.3, [GPC3]H1.4_L1.4, [GPC3]H1.4_L1.5,

[GPC3]H1.4_L1.6, [GPC3]H1.4_L1.7, [GPC3]H1.4_L1.8, [GPC3]H1.4_L1.9, [GPC3]H1.4_L1.10, [GPC3] H1.4_L1.16, [GPC3]H1.4_L1.23, [GPC3]H1.4_L1.29, [GPC3]H1.4_L1.31, [GPC3]H1.4_L1.65, [GPC3] H1.4_L1.66, [GPC3]H1.4_L1.67, [GPC3]H1.4_L1.68, [GPC3]H1.4_L1.70, [GPC3]H1.4_L1.71, [GPC3] H1.4_L1.72 and [GPC3]H1.4_L1.73. In some embodiments, the VH/VL pairs are selected from the group consisting of [GPC3]H1.1_L1.16 and [GPC3]H1.1_L1.69.

In some embodiments, the scFv comprises has a set of 6 CDRs (vhCDR1, vhCDR2, vhCDR3, vlCDR1, vlCDR2 and vlCDR3) from VH/VL pairs selected from the group consisting of: H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31. In some embodiments, the scFv comprises the variable heavy domain and variable light domain of any of the following CD3 binding domains: H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31.

In some embodiments of the heterodimeric antibody, the scFv linker is a charged scFv linker. In some embodiments, the scFv linker is a charged scFv linker having the amino acid sequence (GKPGS)$_4$ (SEQ ID NO: 1).

In some embodiments, the first and second Fc domains are variant Fc domains. In some embodiments, the first and second Fc domains comprise a set of heterodimerization variants selected from the group consisting of those depicted in FIGS. 1A-1E. In some embodiments, the set of heterodimerization variants selected is from the group consisting of S364K/E357Q: L368D/K370S; S364K: L368D/K370S; S364K: L368E/K370S; D401K: T411E/K360E/Q362E; and T366W: T366S/L368A/Y407V, wherein numbering is according to EU numbering.

In some embodiments, the first and second monomers further comprise one or more ablation variants. In some embodiments, the one or more ablation variants are E233P/L234V/L235A/G236del/S267K, wherein numbering is according to EU numbering.

In exemplary embodiments, one of the first or second monomer comprises one or more pI variants. In some embodiments, the one or more pI variants are N208D/Q295E/N384D/Q418E/N421D, wherein numbering is according to EU numbering.

In exemplary embodiments of the heterodimeric antibody, the first monomer comprises amino acid variants S364K/E357Q/E233P/L234V/L235A/G236del/S267K, the second monomer comprises amino acid variants L368D/K370S/N208D/Q295E/N384D/Q418E/N421D/E233P/L234V/L235A/G236del/S267K, and wherein numbering is according to EU numbering.

In some embodiments, the first and second monomers each further comprise amino acid variants 428/434S, wherein numbering is according to EU numbering.

45. A heterodimeric antibody according to 44, wherein the first and second variant Fc domains each further comprise amino acid variants 428/434S, wherein numbering is according to EU numbering.

In another aspect, provided herein is heterodimeric antibody comprising: a) a first monomer, b) a second monomer, and c) a common light chain. The first monomer comprises, from N-terminal to C-terminal, a VH1-CH1-linker 1-scFv-linker 2-CH2-CH3, wherein scFv is an anti-CD3 scFv and CH2-CH3 is a first Fc domain. The second monomer comprises, from N-terminal to C-terminal, a VH1-CH1-hinge-CH2-CH3, wherein CH2-CH3 is a second Fc domain. The common light chain comprising VL-CL. The first variant Fc domain comprises amino acid variants S364K/E357Q, the second variant Fc domain comprises amino acid variants L368D/K370S, the first and second variant Fc domains each comprises amino acid variants E233P/L234V/L235A/G236del/S267K, and the CH1-hinge-CH2-CH3 of the second monomer comprises amino acid variants N208D/Q295E/N384D/Q418E/N421D (EU numbering). The VH and VL comprise the variable heavy domain and the variable light domain of a GPC3 ABD selected from H1.9_L1.187, H1.24_L1.187, H2.91_L1.187 and H1.9_L1.187; and the anti-CD3 scFv comprises the variable heavy domain and the variable light domain of a CD3 binding domain selected from H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31. In some embodiments, the first and second variant Fc domains each further comprise amino acid variants 428/434S.

Also provided herein are nucleic acid compositions comprising nucleic acids encoding the antibodies described herein, expression vector compositions that include such nucleic acids, host cells for making the antibodies that comprise the expression vector compositions, and methods of making the antibodies.

BACKGROUND

Antibody-based therapeutics have been used successfully to treat a variety of diseases, including cancer. An increasingly prevalent avenue being explored is the engineering of single immunoglobulin molecules that co-engage two different antigens. Such alternate antibody formats that engage two different antigens are often referred to as bispecific antibodies. Because the considerable diversity of the antibody variable region (Fv) makes it possible to produce an Fv that recognizes virtually any molecule, the typical approach to bispecific antibody generation is the introduction of new variable regions into the antibody.

A particularly useful approach for bispecific antibodies is to engineer a first binding domain which engages CD3 and a second binding domain which engages an antigen associated with or upregulated on cancer cells so that the bispecific antibody redirects CD3+ T cells to destroy the cancer cells. Heparan sulfate proteoglycan family member Glypican 3 (GPC3) has been previously reported to be highly expressed in hepatocellular carcinoma (particularly of the liver), and minimally expressed in healthy tissue. In view of this, it is believed that anti-GPC3 antibodies are useful, for example, for localizing anti-tumor therapeutics (e.g., chemotherapeutic agents and T cells) to such GPC3 expressing tumors. Previous attempts to target GPC3 such as CD3 bispecific antibodies and CAR-T therapies have shown some success but have demonstrated adverse events such as cytokine release syndrome in preclinical or clinical settings. The present invention provides novel bispecific antibodies to CD3 and GPC3 that are capable of localizing CD3+ effector T cells to GPC3 expressing tumors with improved therapeutic profile.

BRIEF DESCRIPTION OF THE DRAWINGS

FIGS. 1A-1E depict useful pairs of Fc heterodimerization variant sets (including skew and pI variants) that lead to Fc heterodimerization. There are variants for which there are no corresponding "monomer 2" variants; these are pI variants which can be used alone on either monomer.

FIG. 2 depicts a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein.)

FIG. 3 depicts useful ablation variants that ablate FcγR binding (sometimes referred to as "knock outs" or "KO" variants). Generally, ablation variants are found on both monomers, although in some cases they may be on only one monomer FIG. 4 depicts particularly useful embodiments of "non-Fv" components of the invention.

FIG. 5 depicts a number of charged scFv linkers that find use in increasing or decreasing the pI of the subject heterodimeric bsAbs that utilize one or more scFv as a component, as described herein. The (+H) positive linker finds particular use herein, particularly with anti-CD3 $V_L$ and $V_H$ sequences shown herein. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs. Such charged scFv linkers can be used in any of the subject antibody formats disclosed herein that include scFvs (e.g., 1+1 Fab-scFv-Fc and 2+1 Fab$_2$-scFv-Fc formats).

FIG. 6 depicts a number of exemplary domain linkers. In some embodiments, these linkers find use linking a single-chain Fv to an Fc chain. In some embodiments, these linkers may be combined. For example, a GGGGS linker (SEQ ID NO: 2) may be combined with a "half hinge" linker.

FIG. 7A-7D depicts the sequences of several useful 1+1 Fab-scFv-Fc bispecific antibody format heavy chain backbones based on human IgG1, without the Fv sequences (e.g. the scFv and the $V_H$ for the Fab side). Backbone 1 is based on human IgG1 (356E/358M allotype), and includes the S364K/E357Q: L368D/K370S skew variants, C220S on the chain with the S364K/E357Q skew variants, the N208D/Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes S364K: L368D/K370S skew variants, C220S on the chain with the S364K skew variant, the N208D/Q295E/N384D/Q418E/N421D pI variants on the chain with L368D/K370S skew variants, and the E233P/L234V/L235A/G236del/S267K ablation variants on both chains. Backbone 3 is based on human IgG1 (356E/358M allotype), and includes S364K: L368E/K370S skew variants, C220S on the chain with the S364K skew variant, the N208D/Q295E/N384D/Q418E/N421D pI variants on the chain with L368E/K370S skew variants, and the E233P/L234V/L235A/G236del/S267K ablation variants on both chains. Backbone 4 is based on human IgG1 (356E/358M allotype), and includes D401K: K360E/Q362E/T411E skew variants, C220S on the chain with the D401K skew variant, the N208D/Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes S364K/E357Q: L368D/K370S skew variants, C220S on the chain with the S364K/E357Q skew variants, the N208D/Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes S364K/E357Q: L368D/K370S skew variants, C220S on the chain with the S364K/E357Q skew variants, N208D/Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Backbone 8 is based on human IgG4, and includes the S364K/E357Q: L368D/K370S skew variants, the N208D/Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q: L368D/K370S skew variants, the N208D/Q295E/N384D/Q418E/N421D pI variants on the chain with L368D/K370S skew variants. Backbone 10 is based on human IgG2, and includes the S364K/E357Q: L368D/K370S skew variants, the N208D/Q295E/N384D/Q418E/N421D pI variants on the chain with L368D/K370S skew variants as well as a S267K variant on both chains. Backbone 11 is identical to backbone 1, except it includes M428L/N434S Xtend mutations. Backbone 12 is based on human IgG1 (356E/358M allotype), and includes S364K/E357Q: L368D/K370S skew variants, C220S and the P217R/P229R/N276K pI variants on the chain with S364K/E357Q skew variants and the E233P/L234V/L235A/G236del/S267K ablation variants on both chains. Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIGS. 8A-8C depict the sequences of several useful 2+1 Fab$_2$-scFv-Fc bispecific antibody format heavy chain backbones based on human IgG1, without the Fv sequences (e.g. the scFv and the $V_H$ for the Fab side). Backbone 1 is based on human IgG1 (356E/358M allotype), and includes the S364K/E357Q: L368D/K370S skew variants, the N208D/Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes S364K: L368D/K370S skew variants, the N208D/Q295E/N384D/Q418E/N421D pI variants on the chain with L368D/K370S skew variants, and the E233P/L234V/L235A/G236del/S267K ablation variants on both chains. Backbone 3 is based on human IgG1 (356E/358M allotype), and includes S364K: L368E/K370S skew variants, the N208D/Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes D401K: K360E/Q362E/T411E skew variants, the N208D/Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes S364K/E357Q: L368D/

Figure 15A:
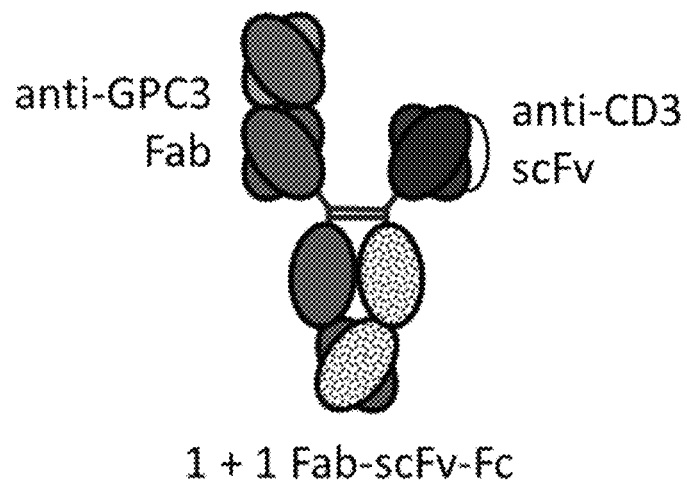

K370S skew variants, the N208D/Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes S364K/E357Q: L368D/K370S skew variants, N208D/Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Backbone 8 is identical to backbone 1, except it includes M428L/N434S Xtend mutations. Backbone 9 is based on human IgG1 (356E/358M allotype), and includes S364K/E357Q: L368D/K370S skew variants, the P217R/P229R/N276K pI variants on the chain with S364K/E357Q skew variants and the E233P/L234V/L235A/G236del/S267K ablation variants on both chains. Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 9 depicts the sequences of several useful constant light domain backbones based on human IgG1, without the Fv sequences (e.g. the scFv or the Fab). Included herein are constant light backbone sequences that are 90, 95, 98 and 99% identical (as defined herein) to the recited sequences, and/or contain from 1, 2, 3, 4, 5, 6, 7, 8, 9 or 10 additional amino acid modifications.

FIG. 10A-10F depicts sequences for exemplary anti-CD3 scFvs suitable for use in the bispecific antibodies of the invention. The CDRs are underlined, the scFv linker is double underlined (in the sequences, the scFv linker is a positively charged scFv (GKPGS)$_4$ linker (SEQ ID NO: 15), although as will be appreciated by those in the art, this linker can be replaced by other linkers, including uncharged or negatively charged linkers, some of which are depicted in FIG. 5), and the slashes indicate the border(s) of the variable domains. In addition, the naming convention illustrates the orientation of the scFv from N- to C-terminus. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

FIG. 11A-11B depicts the antigen sequences for a number of antigens of use in the invention, including both human and cyno, to facilitate the development of antigen binding domains that bind to both for ease of clinical development.

FIG. 12 depicts the variable heavy and variable light chain sequences for humanized GPC3-A variants. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Further, as for all the sequences in the Figures, these $V_H$ and $V_L$ sequences can be used either in a scFv format or in a Fab format. Furthermore, each of the variable heavy domains depicted herein can be paired with any other αGPC3-A variable light domain; and each of the variable light domains depicted herein can be paired with any other αGPC3-A variable heavy domain.

FIG. 13A-13G depicts the variable heavy and variable light chain sequences for GPC3-A variants engineered for reduced degradation (e.g. aspartic acid isomerization and deamidation) liability, modulated GPC3 binding affinity, and/or selectivity for high GPC3 expression cell lines. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Further, as for all the sequences in the Figures, these $V_H$ and $V_L$ sequences can be used either in a scFv format or in a Fab format. Furthermore, each of the variable heavy domains depicted herein can be paired with any other αGPC3 variable light domain; and each of the variable light domains depicted herein can be paired with any other αGPC3 variable heavy domain.

FIG. 14A-14E depicts illustrative GPC3-A variants formatted as bivalent anti-GPC3 mAbs and IgG1 backbone with E233P/L234V/L235A/G236del/S267K ablation variant. CDRs are underlined and slashes indicate the border(s) between the variable regions and constant domain. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Furthermore, as for all the sequences in the Figures, these $V_H$ and $V_L$ sequences can be used either in a scFv format or in a Fab format.

Figure 15B:
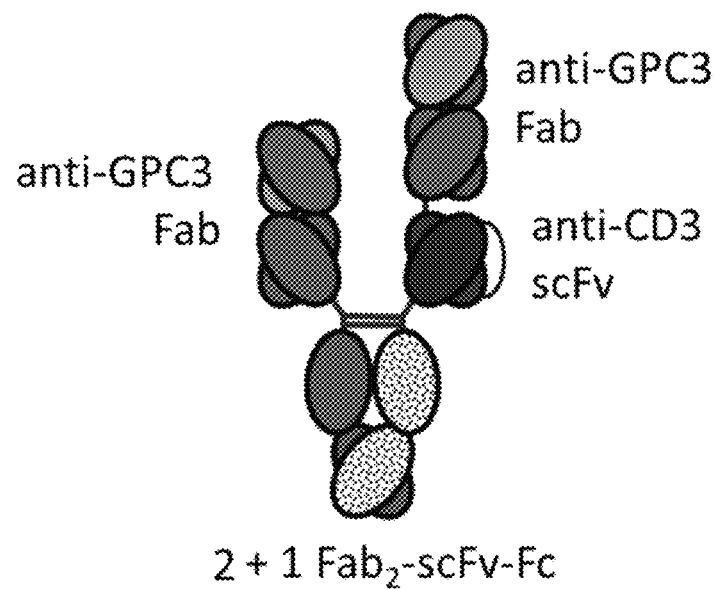

FIG. 15A-15B depicts a couple of formats of the present invention. FIG. 15A depicts the "1+1 Fab-scFv-Fc" format, with a first Fab arm binding GPC3 and a second scFv arm binding CD3. FIG. 15B depicts the "2+1 Fab$_2$-scFv-Fc" format, with a first Fab arm binding GPC3 and a second Fab-scFv arm, wherein the Fab binds GPC3 and the scFv binds CD3.

FIG. 16A-16C depicts the sequences for illustrative αGPC3×αCD3 bsAbs in the 1+1 Fab-scFv-Fc format and comprising a CD3 High scFv (H1.30_L1.47 in either the VHVL orientation or the VLVH orientation). CDRs are underlined and slashes indicate the border(s) between the variable regions and other chain components (e.g. constant region and domain linkers). It should be noted that the αGPC3×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIG. 17A-17G depicts the sequences for illustrative αGPC3×αCD3 bsAbs in the 1+1 Fab-scFv-Fc format and comprising a CD3 High-Int #1 scFv (H1.32_L1.47 in either the VHVL orientation or the VLVH orientation). CDRs are underlined and slashes indicate the border(s) between the variable regions and other chain components (e.g. constant region and domain linkers). It should be noted that the αGPC3×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIG. 18A-18B depicts the sequences for illustrative αGPC3×αCD3 bsAbs in 2+1 Fab$_2$-scFv-Fc format and comprising a CD3 High scFv (H1.30_L1.47 in either the VHVL orientation or the VLVH orientation). CDRs are underlined and slashes indicate the border(s) between the variable regions and other chain components (e.g. constant region and domain linkers). It should be noted that the αGPC3×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIG. 19A-19H depicts the sequences for illustrative αGPC3×αCD3 bsAbs in the 2+1 Fab$_2$-scFv-Fc format and comprising a CD3 High-Int #1 scFv (H1.32_L1.47 in either the VHVL orientation or the VLVH orientation). CDRs are underlined and slashes indicate the border(s) between the variable regions and other chain components (e.g. constant region and domain linkers). It should be noted that the αGPC3×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum FIG. 20A-20E depicts the sequences for illustrative αGPC3×αCD3 bsAbs in the 2+1 Fab$_z$-scFv-Fc format and comprising a CD3 High-Int #2 scFv (H1.89_L1.47 in either the VHVL orientation or the VLVH orientation). CDRs are underlined and slashes indicate the border(s) between the variable regions and other chain components (e.g. constant region and domain linkers). It should be noted that the αGPC3×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIG. 21 depicts sequences for illustrative αGPC3-A×αCD3 bsAbs in the 2+1 Fab$_2$-scFv-Fc format and comprising a CD3 Intermediate scFv (H1.33_L1.47 in either the VHVL orientation or the VLVH orientation). CDRs are underlined and slashes indicate the border(s) between the variable regions and other chain components (e.g. constant region and domain linkers). It should be noted that the αGPC3-A×αCD3 bsAbs can utilize variable region, Fc region, and constant domain sequences that are 90, 95, 98 and 99% identical (as defined herein), and/or contain from 1, 2, 3, 4, 5, 6, 7, 8, 9 or 10 amino acid substitutions. In addition, each sequence outlined herein can include or exclude the M428L/N434S variants in one or preferably both Fc domains, which results in longer half-life in serum.

FIG. 22 depicts sequences based on a comparator αGPC3×αCD3 bispecific antibody as disclosed in WO 2016/047722.

FIG. 23 depicts binding affinity of 5 GPC-A affinity variants H1.1_L1.6, H1.1_L1.29, H1.1_L1.16, H1.1_L1.23 and H1.1_L1.31 (formatted as 1+1 Fab-scFv-Fc with CD3 High-Int #1 scFv) to human and cynomolgus GPC3 antigen. The affinity variants demonstrated a broad range of binding (4-400 nM KD) and were cross-reactive for cynomolgus GPC3.

Figure 24:
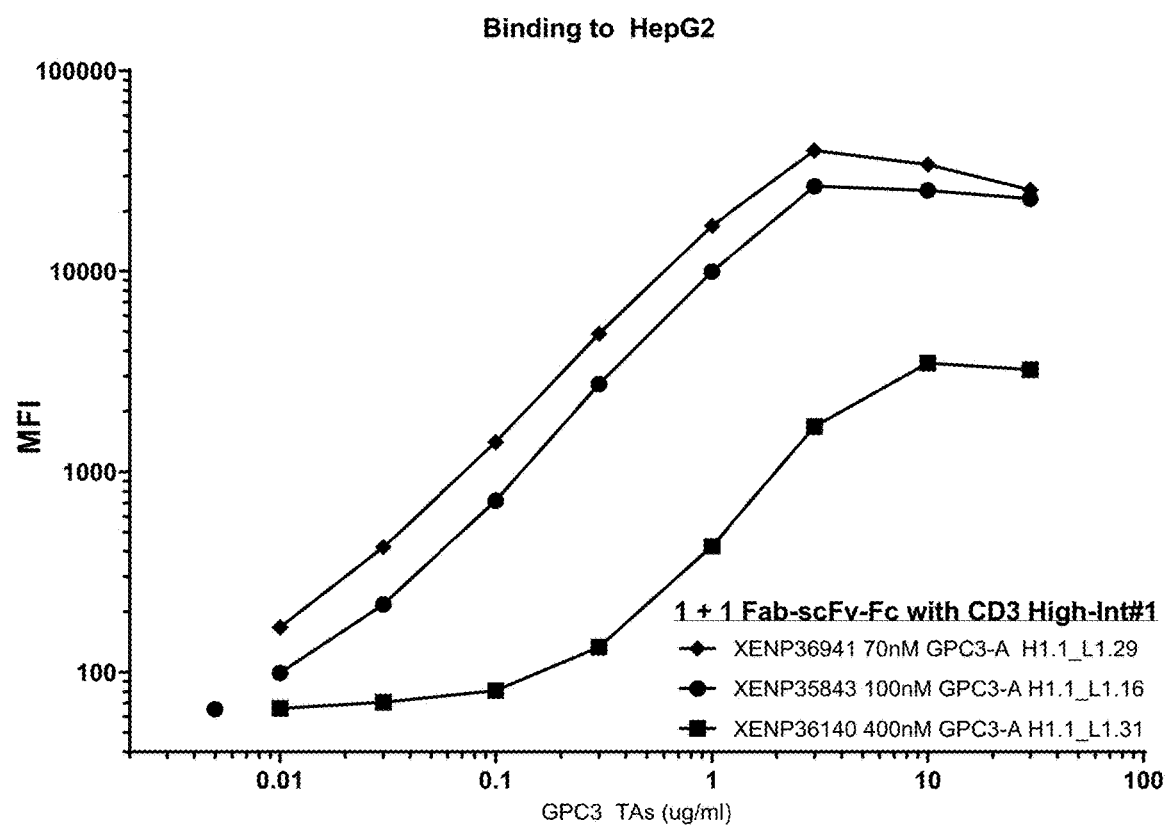

FIG. 24 depicts binding of 3 GPC-A affinity variants H1.1_L1.29, H1.1_L1.16, and H1.1_L1.31 (formatted as 1+1 Fab-scFv-Fc with CD3 High-Int #1 scFv) to HepG2 (GPC3$^{high}$) cells.

FIG. 25 depicts binding of GPC3-A variants engineered to remove degradation liabilities to human GPC3-A. Several of the variants demonstrated reduced binding affinity to GPC3.

FIG. 26 depicts binding of GPC3-A variants engineered to remove degradation liabilities to human and cynomolgus GPC3-A. Several of the variants demonstrated reduced, biphasic, or abrogated binding to GPC3

FIG. 27 depicts A) induction of RTCC and B) activation of T cells (as indicated by IFNγ secretion) by αGPC3×αCD3 bsAb comparator XENP31308. XENP31308 induces potent RTCC and activation of T cells in the presence of each of GPC3$^{high}$ HepG2, GPC3$^{med}$ Huh7, and GPC3$^{low}$ HEK293 cells (10:1 effector:target ratio).

FIG. 28 depicts A) induction of RTCC and B) activation of T cells (as indicated by IFNγ secretion) by αGPC3×αCD3 bsAb comparator XENP31308 at a 1:1 effector:target ratio.

Figure 29:
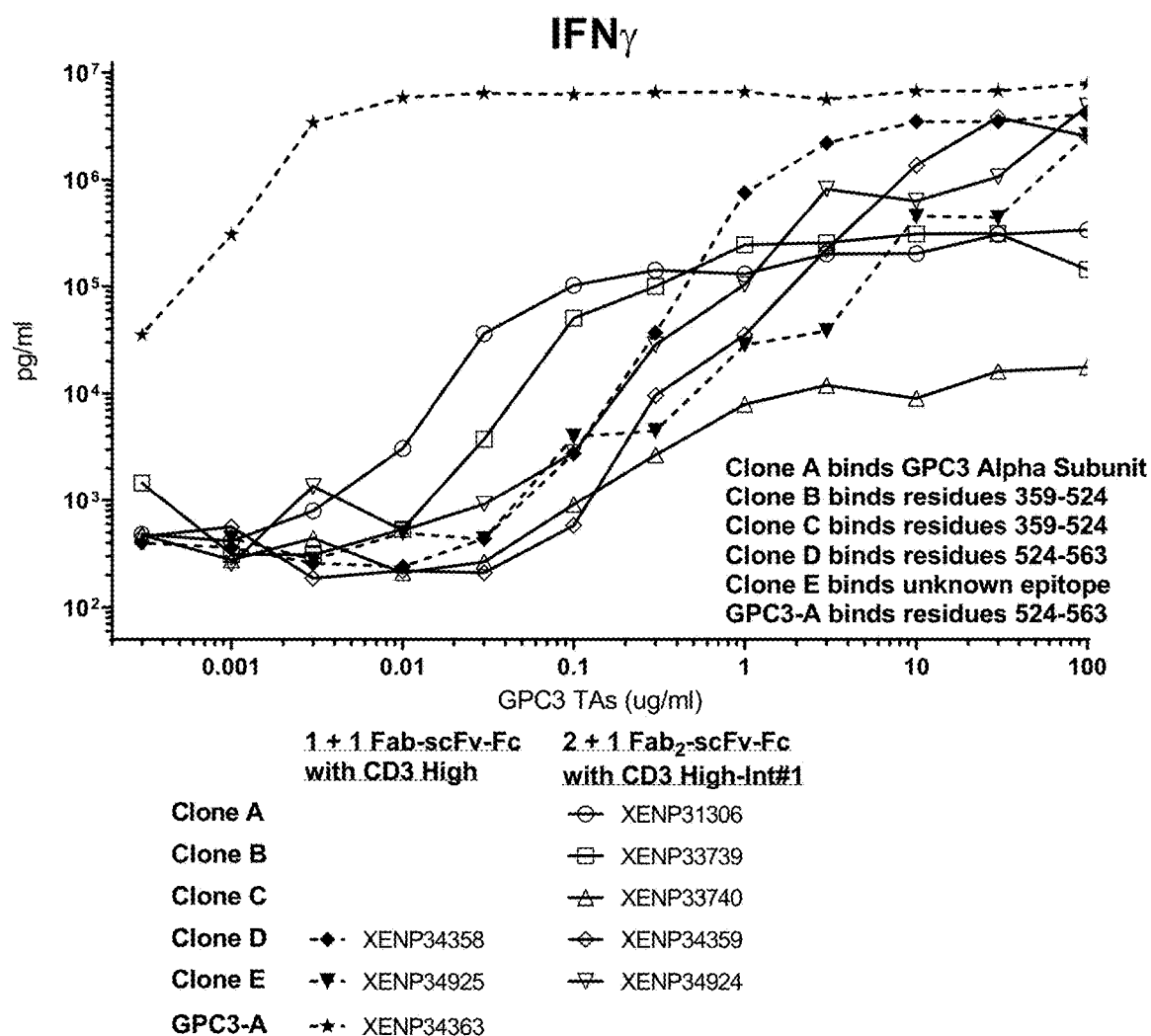

FIG. 29 depicts activation of T cells (as indicated by IFNγ release) in the presence of HepG2 (GPC3$^{high}$) cells by GPC3 binding domains binding different GPC3 epitopes formatted as 2+1 Fab$_2$-scFv-Fc bsAbs with CD3 High-Int #1. Each of the bsAbs having GPC3 binding domains other than GPC3-A activated T cells less potently than bsAb having GPC3-A binding domain.

FIG. 30 depicts binding of A) GPC3-A H1.1_L1.16 (100 nM) and B) GPC3-A H1.1_L1.31 (400 nM) variants to HepG2 (GPC3$^{high}$) in the context of 1+1 Fab-scFv-Fc bsAb, 2+1 Fab$_2$-scFv-Fc bsAb, and bivalent monospecific mAb. BsAbs in the 2+1 format demonstrated more potent binding in comparison to bsAbs in the 1+1 Format (and comparable binding to the bivalent monospecific mAb). Potency shift from 1+1 format to 2+1 format was more pronounced for the lower binding affinity GPC3-A H1.1_L1.31 (400 nM) variant.

FIG. 31 depicts A) induction of RTCC and B) cytokine release by T cells following incubation of HepG2 (GPC3$^{high}$) cells with T cells (10:1 effector:target ratio) and αGPC3×αCD3 bsAbs in the 1+1 Fab-scFv-Fc format with different CD3 binding affinities. Detuning the CD3 binding affinity from CD3 High to CD3 High-Int #1 provide substantial reduction in potency of RTCC, and more importantly, IFNγ release to potentially mitigate cytokine release syndrome.

FIG. 32 depicts A) induction of RTCC and B) cytokine release by T cells following incubation of HepG2 (GPC3$^{high}$) cells with T cells (10:1 effector:target ratio) and αGPC3×αCD3 bsAbs in the 2+1 Fab$_2$-scFv-Fc format with different CD3 binding affinities. Detuning the CD3 binding affinity from CD3 High to CD3 High-Int #1 did not provide substantial reduction in potency, but further reduction to CD3 High-Int #2 did provide substantial reduction in potency.

FIG. 33 depicts A) induction of RTCC and B) cytokine secretion in the presence of HepG2 (GPC3$^{high}$) cells by 3

GPC3-A affinity variants formatted as 2+1 Fab$_2$-scFv-Fc with CD3 High-Int #2[VLVH] scFv. The bsAbs induced RTCC in a manner correlating with their reduced affinities, with XENP37625 having the 70 nm GPC3 affinity variant demonstrating the strongest potency, and XENP37626 having the 400 nM GPC3 affinity variant demonstrating the weakest potency. Surprisingly, the H1.1_L1.23 200 nM affinity variant did not appear to differentiate significantly from the 400 nM affinity variant.

FIG. 34 depicts induction of RTCC on A) HepG2 and B) HEK293 cells by additional αGPC3×αCD3 bsAbs of the invention (XENP36935, XENP37430, XENP34364, XENP34920, XENP35843, XENP36939, and XENP37433) at a 1:1 effector:target ratio.

FIG. 35 depicts induction of IFNγ release by T cells in the presence of A) HepG2 and B) HEK293 cells and additional αGPC3×αCD3 bsAbs of the invention (XENP36935, XENP37430, XENP34364, XENP34920, XENP35843, XENP36939, and XENP37433) at a 1:1 effector:target ratio. XENP37430 and XENP34920 demonstrated the highest potency on HepG2, while XENP36939 had the lowest potency. The potency in inducing IFNγ release by each bsAb was proportional to their potency in RTCC induction. Most of the bsAbs selectivity induced killing (and cytokine release) in the presence of HepG2 (GPC$^{high}$) over HEK293 (GPC$^{low}$).

FIG. 36 depicts induction of RTCC on HepG2 by αGPC3×αCD3 bsAbs of the invention (XENP36935, XENP37430, XENP37625, XENP35843, XENP34920, XENP37624, XENP36939, XENP37433, and XENP37626) and comparator bsAb XENP31308 at a 10:1 effector:target ratio. BsAbs XENP34920, XENP37430, XENP37625, and XENP37624 demonstrated similar potency (less than EC50 of 100 ng/ml) as comparator XENP31308. Other bsAbs XENP35843, XENP36935, XENP37433, and XENP37626 were much less potent but were able to achieve efficacious killing at higher concentrations. XENP36939 did not demonstrate any killing.

Figure 37:
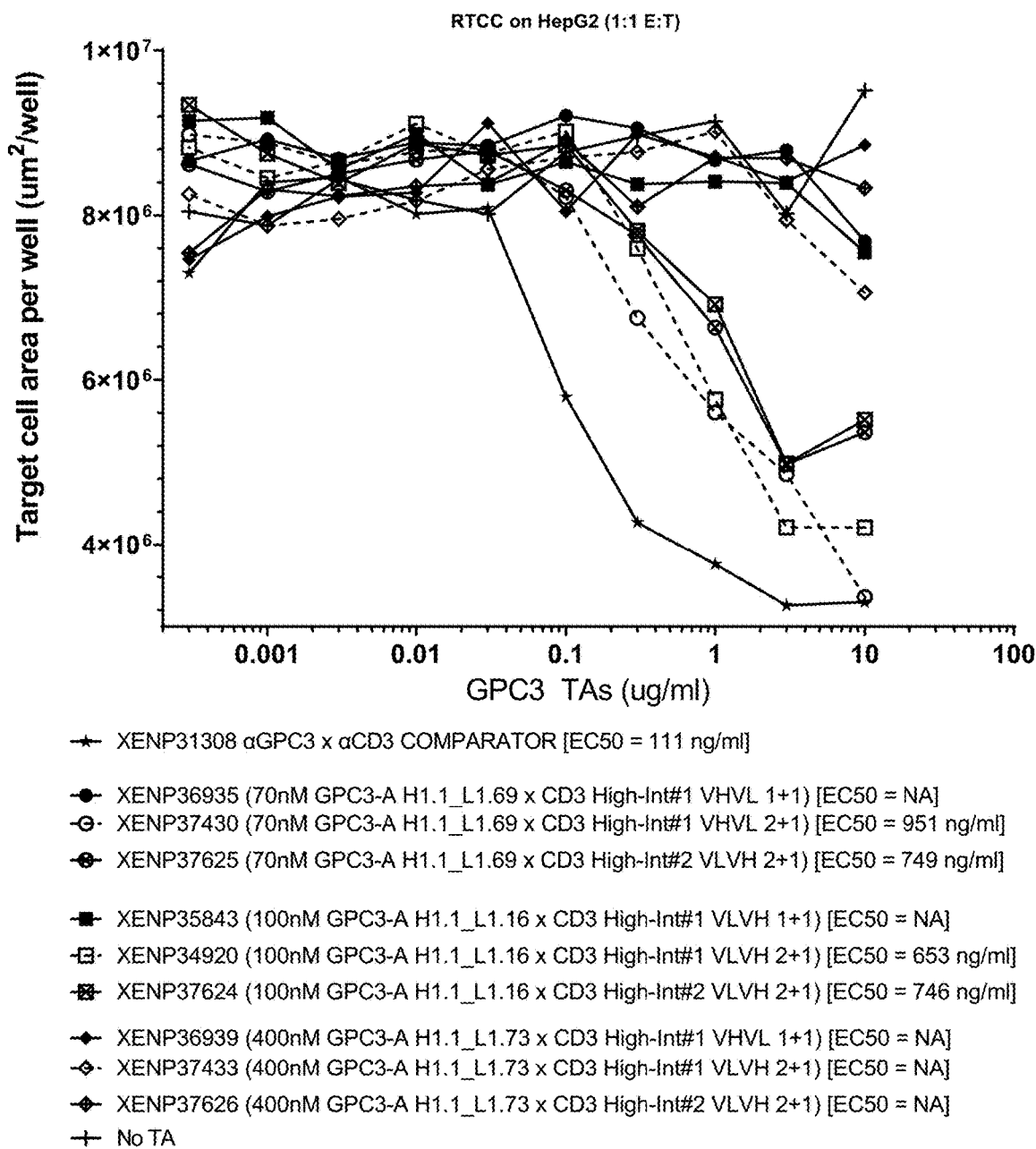

FIG. 37 depicts induction of RTCC on HepG2 by αGPC3×αCD3 bsAbs of the invention (XENP36935, XENP37430, XENP37625, XENP35843, XENP34920, XENP37624, XENP36939, XENP37433, and XENP37626) and comparator bsAb XENP31308 at a 1:1 effector:target ratio.

Figure 38:
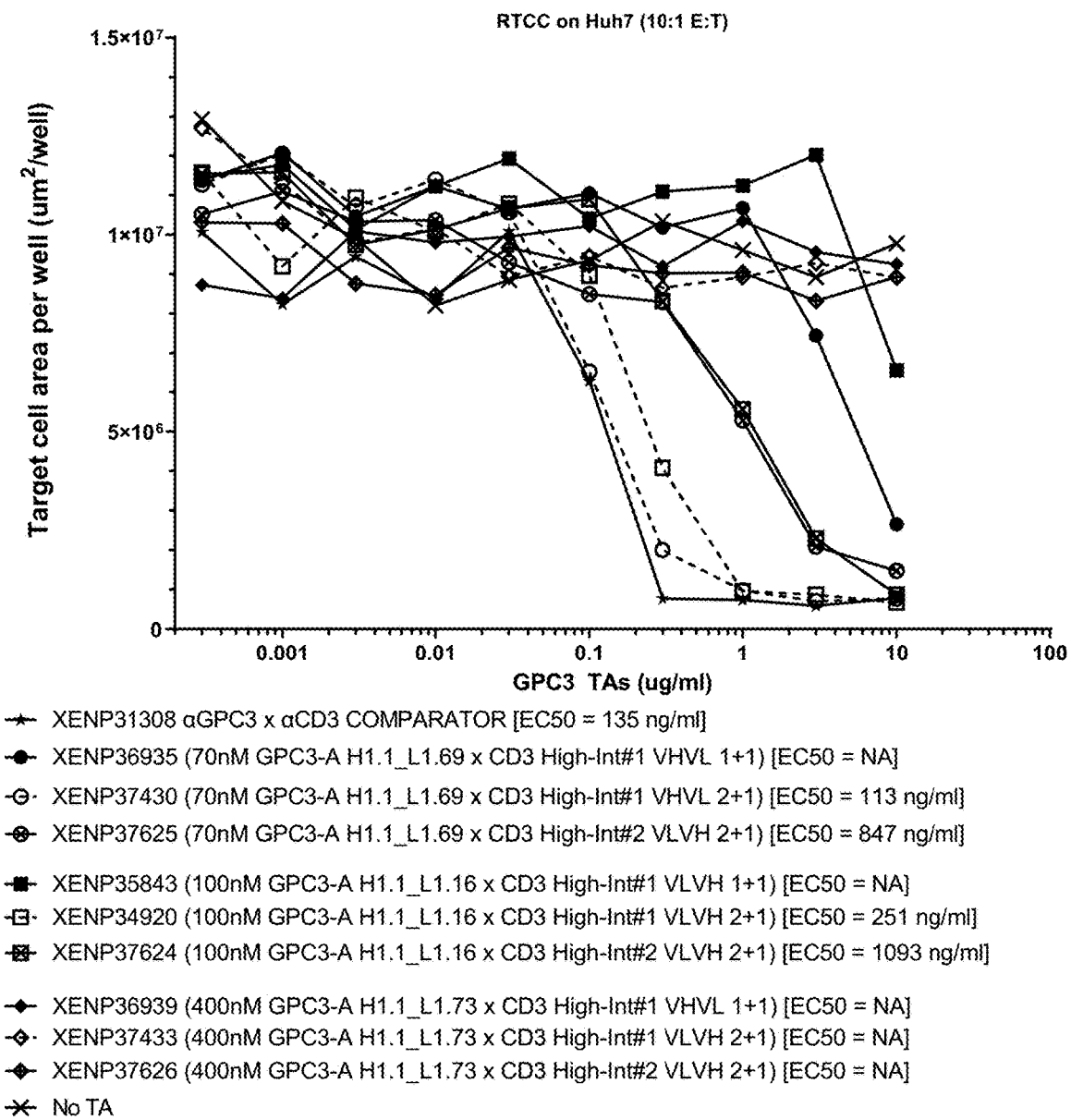

FIG. 38 depicts induction of RTCC on Huh7 by αGPC3×αCD3 bsAbs of the invention (XENP36935, XENP37430, XENP37625, XENP35843, XENP34920, XENP37624, XENP36939, XENP37433, and XENP37626) and comparator bsAb XENP31308 at a 10:1 effector:target ratio.

Figure 39:
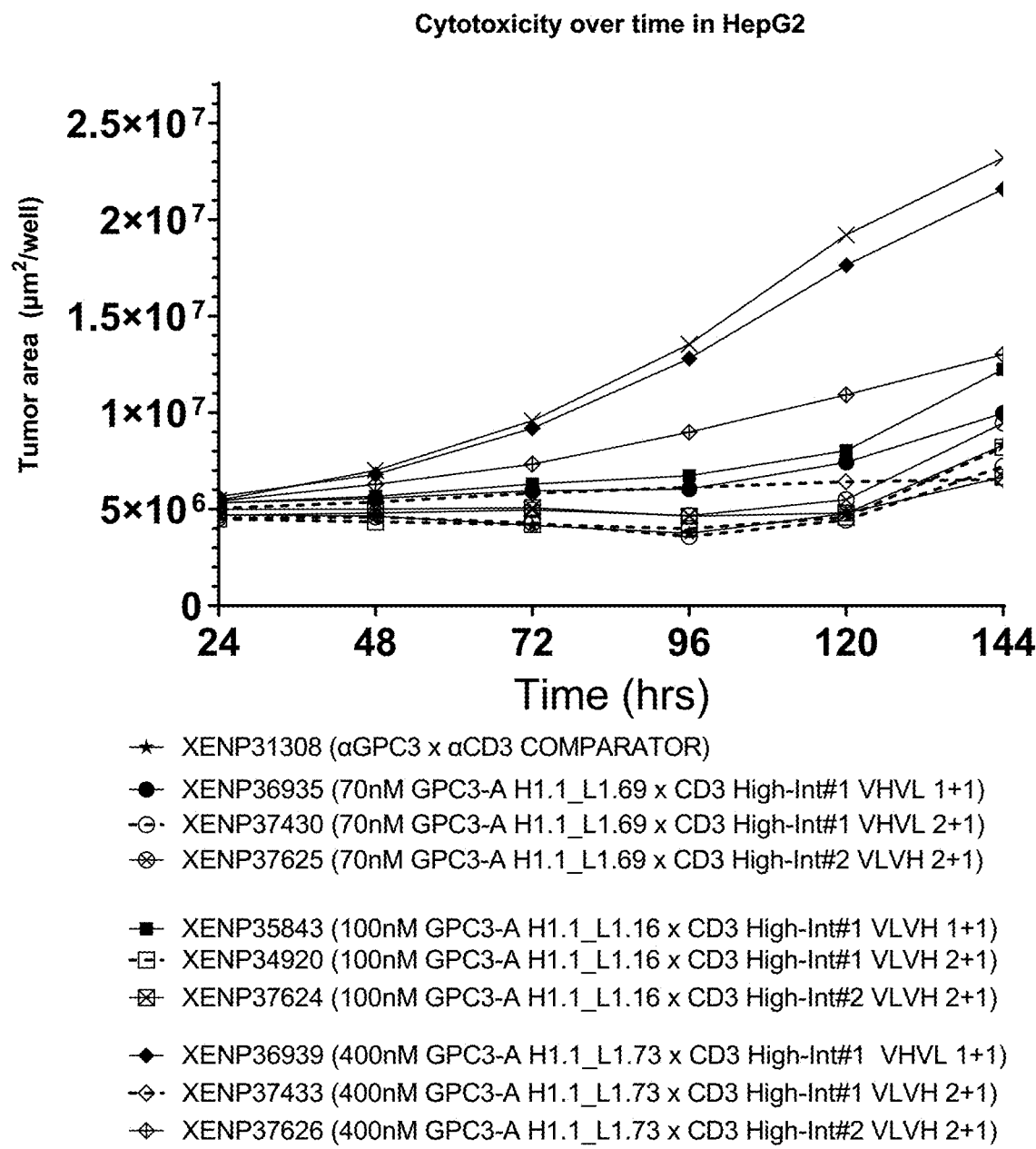

FIG. 39 depicts the growth of GPC3high HepG2 tumors over time in a 2D Incucyte model. A 10 ug/ml treatment concentration of each test article and a 10:1 E:T ratio were used. As seen in the other Incucyte studies, XENP36939 did not show any significant activity, with an efficacy similar to the PBS control. However, most other test including XENP34920, XENP37430, XENP36935, XENP37624, and XENP37625 showed a similar efficacy as the comparator XENP31308.

Figure 40:
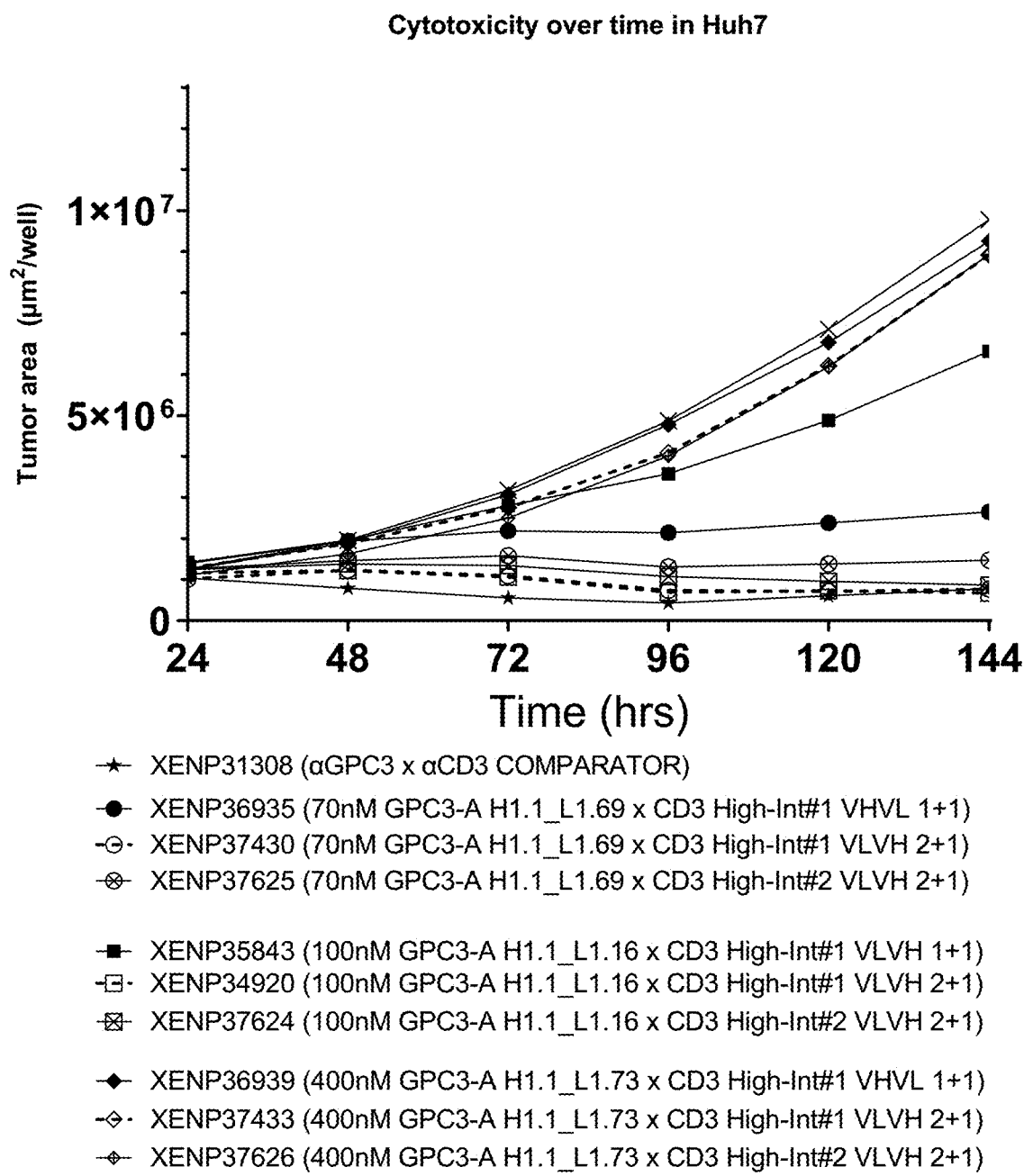

FIG. 40 depicts the growth of GPC3$^{med}$ Huh7 tumor cells over time in a 2D Incucyte model. A 10 ug/ml treatment concentration of each test article was used. None of the bsAbs having the 400 nM GPC3 binder (XENP36939, XENP37433, or XENP37626) were able to significantly inhibit cell growth. However, 2+1 bsAbs having either the 70 nM or 100 nM GPC3 binders were all able to prevent growth with a similar efficacy as the comparator.

Figure 41:
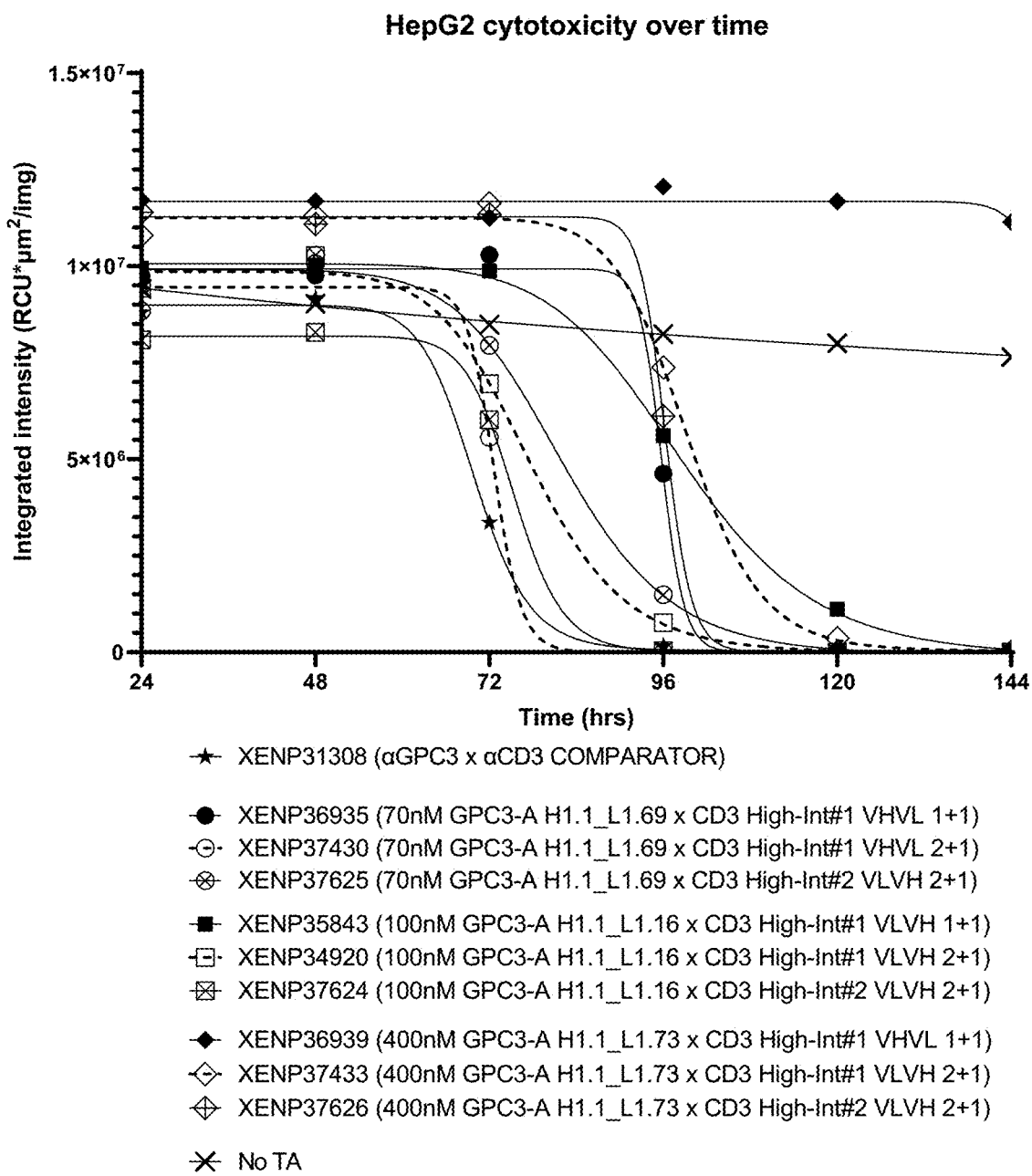

FIG. 41 depicts the results of a 3D spheroid RTCC model using Incucyte. 1,000 HepG2 cells (which have a doubling time of 24 hr) are seeded in a well and given 72-96 hours to grow, and then 40,000 PBMCs are added (resulting in an E:T ratio of approximately 3:1) along with the indicated bsAb at a concentration of 10 ug/ml. The intensity of each signal (tumor or immune cell) was integrated over each well. The curves for XENP34920 and XENP37624 were more similar than expected, given that XENP37625 has a lower affinity CD3 arm (High-Int #2) compared to XENP36935 (High-In #1). After 144 hours all bsAbs but XENP36939 show 100% efficacy.

Figure 42:
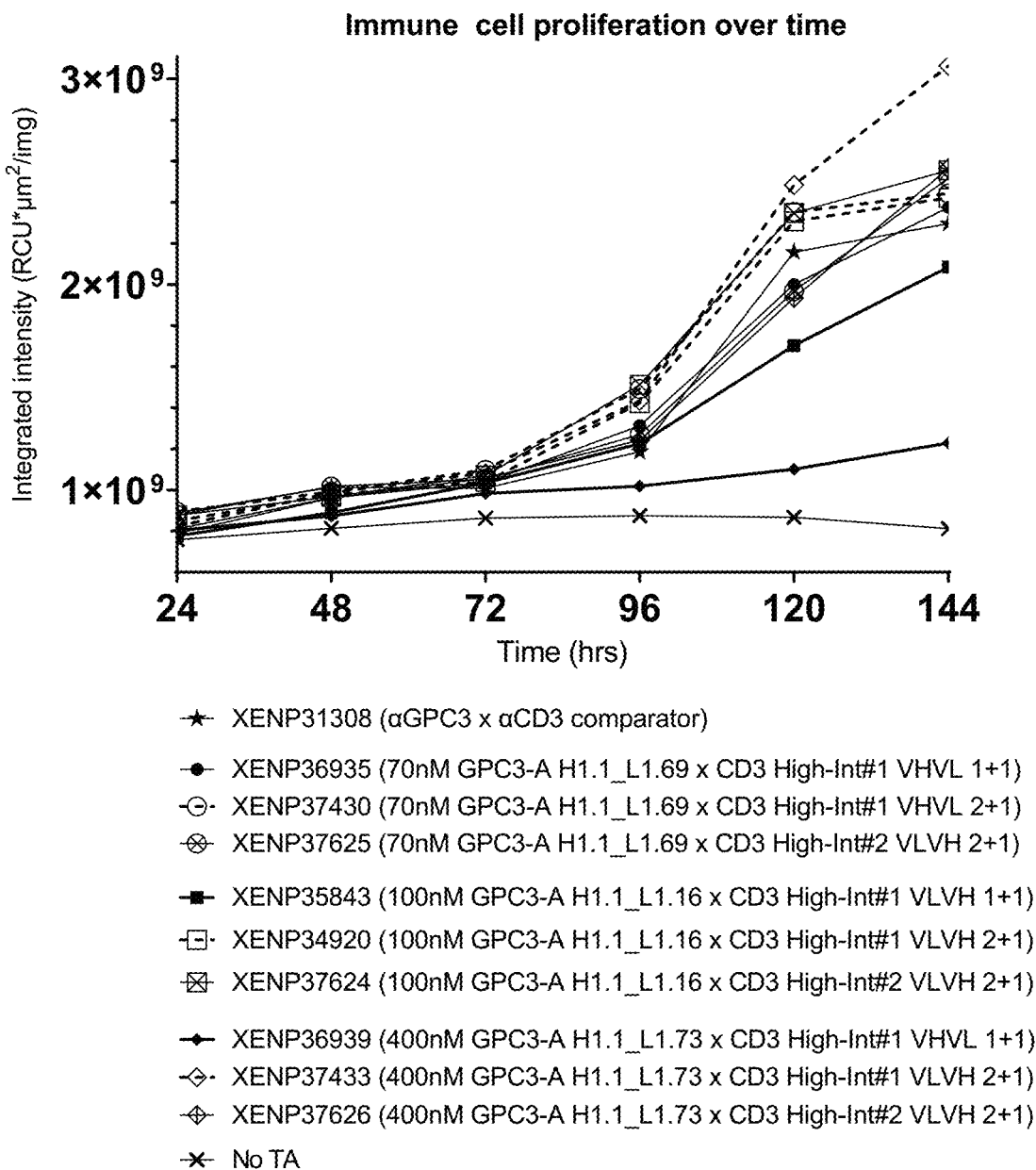

FIG. 42 depicts the results of a 3D spheroid RTCC model using Incucyte. 1,000 HepG2 cells (which have a doubling time of 24 hr) are seeded in a well and given 72-96 hours to grow, and then 40,000 PBMCs are added (resulting in an E:T ratio of approximately 3:1) along with the indicated bsAb at a concentration of 10 ug/ml. The intensity of each signal (tumor or immune cell) was integrated over each well. Interestingly, one of the weaker affinity 400 nM GPC3 binders showed the highest level of proliferation. With the exception of the 1+1 constructs XENP35843 and XENP36939, the rest of the bsAbs showed a similar or higher level of immune cell proliferation than the comparator XENP31308.

Figure 43:
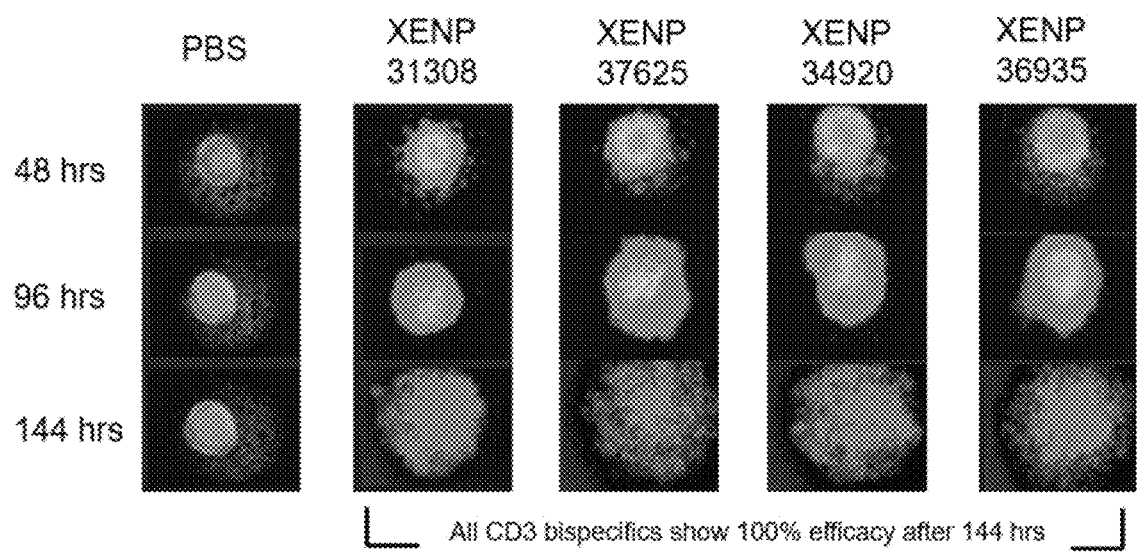

FIG. 43 depicts photographs taken of the results of a 3D spheroid RTCC model using Incucyte. 1,000 HepG2 cells (which have a doubling time of 24 hr) are seeded in a well and given 72-96 hours to grow, and then 40,000 PBMCs are added (resulting in an E:T ratio of approximately 3:1) along with the indicated bsAb at a concentration of 10 ug/ml. The target tumor cell spheroid can be most clearly seen in the PBS control column, where PBMCs are clustered around the spheroid and remain unchanged over time. In comparing the PBS control column with the columns treated by XENP31308, XENP37625, XENP34920, and XENP36935, the expansion of the PBMCs as the immune cells kill the tumor cells can be visualized.

FIGS. 44A to 44J depict several formats of the present invention. The first is the 1+1 Fab-scFv-Fc format, with a first and a second anti-antigen binding domain. Additionally, mAb-Fv, mAb-scFv, Central-scFv, Central-Fv, one-armed central-scFv, one scFv-mAb, scFv-mAb and a dual scFv format are all shown. For all of the scFv domains depicted, they can be either N- to C-terminus variable heavy-(optional linker)-variable light, or the opposite. In addition, for the one-armed scFv-mAb, the scFv can be attached either to the N-terminus of a heavy chain monomer or to the N-terminus of the light chain.

DETAILED DESCRIPTION

The present invention provides heterodimeric bispecific antibodies that bind to human CD3ε and human GPC3.

A. Overview

Anti-bispecific antibodies that co-engage CD3 and a tumor antigen target are used to redirect T cells to attack and lyse targeted tumor cells. Examples include the BiTE® and DART formats, which monovalently engage CD3 and a tumor antigen. While the CD3-targeting approach has shown considerable promise, a common side effect of such therapies is the associated production of cytokines, often leading to toxic cytokine release syndrome. Because the anti-CD3 binding domain of the bispecific antibody engages all T cells, the high cytokine-producing CD4 T cell subset is recruited. Moreover, the CD4 T cell subset includes regulatory T cells, whose recruitment and expansion can potentially lead to immune suppression and have a negative impact on long-term tumor suppression. In addition, these formats do not contain Fc domains and show very short serum half-lives in patients.

Provided herein are novel anti-CD3×anti-GPC3 (also referred to as anti-GPC3×anti-CD3, αCD3×αGPC3, αGPC3×αCD3 or sometimes just GPC3×CD3) heterodimeric bispecific antibodies and methods of using such antibodies for the treatment of cancers. In particular, provided herein are anti-CD3, anti-GPC3 bispecific antibodies in a variety of formats. These bispecific antibodies are useful for the treatment of cancers, particularly those with increased GPC3 expression such as renal cell carcinoma. Such antibodies are used to direct CD3+ effector T cells to GPC3+ tumors, thereby allowing the CD3+ effector T cells to attack and lyse the GPC3+ tumors.

Additionally, in some embodiments, the disclosure provides bispecific antibodies that have different binding affinities to human CD3 that can alter or reduce the potential side effects of anti-CD3 therapy. That is, in some embodiments the antibodies described herein provide antibody constructs comprising anti-CD3 antigen binding domains that are "strong" or "high affinity" binders to CD3 (e.g. one example are heavy and light variable domains depicted as H1.30_L1.47 (optionally including a charged linker as appropriate)) and also bind to GPC3. In other embodiments, the antibodies described herein provide antibody constructs comprising anti-CD3 antigen binding domains that are "lite" or "lower affinity" binders to CD3. Additional embodiments provides antibody constructs comprising anti-CD3 antigen binding domains that have intermediate or "medium" affinity to CD3 that also bind to GPC3. While a very large number of anti-CD3 antigen binding domains (ABDs) can be used, particularly useful embodiments use 6 different anti-CD3 ABDs, although they can be used in two scFv orientations as discussed herein. Affinity is generally measured using a Biacore assay.

It should be appreciated that the "high, medium, low" anti-CD3 sequences provided herein can be used in a variety of heterodimerization formats as discussed herein. In general, due to the potential side effects of T cell recruitment, exemplary embodiments utilize formats that only bind CD3 monovalently, such as depicted in FIGS. 15A and 15B, and in the formats depicted herein, it is the CD3 ABD that is a scFv as more fully described herein. In contrast, the subject bispecific antibodies can bind GPC3 either monovalently (e.g. FIG. 15A) or bivalently (e.g. FIG. 15B).

Provided herein are compositions that include GPC3 binding domains, including antibodies with such GPC3 binding domains (e.g., GPC3×CD3 bispecific antibodies). Subject antibodies that include such GPC3 binding domains advantageously elicit a range of different immune responses, depending on the particular GPC3 binding domain used. For example, the subject antibodies exhibit differences in selectivity for cells with different GPC3 expression, potencies for GPC3 expressing cells, ability to elicit cytokine release, and sensitivity to soluble GPC3. Such GPC3 binding domains and related antibodies find use, for example, in the treatment of GPC3 associated cancers.

Accordingly, in one aspect, provided herein are heterodimeric antibodies that bind to two different antigens, e.g. the antibodies are "bispecific", in that they bind two different target antigens, generally GPC3 and CD3 as described herein. These heterodimeric antibodies can bind these target antigens either monovalently (e.g. there is a single antigen binding domain such as a variable heavy and variable light domain pair) or bivalently (there are two antigen binding domains that each independently bind the antigen). In some embodiments, the heterodimeric antibody provided herein includes one CD3 binding domain and one GPC3 binding domain (e.g., heterodimeric antibodies in the "1+1 Fab-scFv-Fc" format described herein). In other embodiments, the heterodimeric antibody provided herein includes one CD3 binding domain and two GPC3 binding domains (e.g., heterodimeric antibodies in the "2+1 Fab2-scFv-Fc" formats described herein). The heterodimeric antibodies provided herein are based on the use different monomers which contain amino acid substitutions that "skew" formation of heterodimers over homodimers, as is more fully outlined below, coupled with "pI variants" that allow simple purification of the heterodimers away from the homodimers, as is similarly outlined below. The heterodimeric bispecific antibodies provided generally rely on the use of engineered or variant Fc domains that can self-assemble in production cells to produce heterodimeric proteins, and methods to generate and purify such heterodimeric proteins.

B. Nomenclature

The antibodies provided herein are listed in several different formats. In some instances, each monomer of a particular antibody is given a unique "XENP" number, although as will be appreciated in the art, a longer sequence might contain a shorter one. For example, a "scFv-Fc" monomer of a 1+1 Fab-scFv-Fc format antibody may have a first XENP number, while the scFv domain itself will have a different XENP number. Some molecules have three polypeptides, so the XENP number, with the components, is used as a name. Thus, the molecule XENP33744, which is in 2+1 Fab2-scFv-Fc format, comprises three sequences (see FIG. 18) a "Fab-Fc Heavy Chain" monomer; 2) a "Fab-scFv-Fc Heavy Chain" monomer; and 3) a "Light Chain" monomer or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab includes, the full heavy chain sequence, the variable heavy domain sequence and the three CDRs of the variable heavy domain sequence, the full light chain sequence, a variable light domain sequence and the three CDRs of the variable light domain sequence. A Fab-scFv-Fc monomer includes a full length sequence, a variable heavy domain sequence, 3 heavy CDR sequences, and an scFv sequence (include scFv variable heavy domain sequence, scFv variable light domain sequence and scFv linker). Note that some molecules herein with a scFv domain use a single charged scFv linker (+H), although others can be used. In addition, the naming nomenclature of particular antigen binding domains (e.g., GPC3 and CD3 binding domains) use a "Hx.xx_Ly.yy" type of format, with the numbers being unique identifiers to particular variable chain sequences. Thus, an Fv domain of the antigen binding domain is "H1 L1", which indicates that the variable heavy domain, H1, was combined with the light domain L1. In the case that these sequences are used as scFvs, the designation "H1 L1", indicates that the variable heavy domain, H1 is combined with the light domain, L1, and is in VH-linker-VL orientation, from N- to C-terminus. This molecule with the identical sequences of the heavy and light variable domains but in the reverse order (VL-linker-VH orientation, from N- to C-terminus) would be designated "L1_H1.1". Similarly, different constructs may "mix and match" the heavy and light chains as will be evident from the sequence listing and the figures.

Additionally, the bispecific antibodies of the invention are referred to herein as "anti-CD3×anti-GPC3", "αCD3× αGPC3", "αGPC3×αCD3" or sometimes just "GPC3× CD3". The order of the antigens is not determinative as will be discussed below, although the majority of the formats that utilize as scFv have the an anti-CD3 ABD as the scFv.

C. Definitions

In order that the application may be more completely understood, several definitions are set forth below. Such definitions are meant to encompass grammatical equivalents.

By "GPC3" herein is meant a protein belonging to the claudin family. GPC3 sequences are depicted, for example, in FIG. 11. The ABDs of the invention bind to human GPC3.

By "ablation" herein is meant a decrease or removal of activity. Thus for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a Biacore, SPR or BLI assay. Of particular use in the ablation of FcγR binding are those shown in FIG. 3, which generally are added to both monomers.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific phagocytic cells that express FcγRs recognize bound antibody on a target cell and subsequently cause phagocytosis of the target cell.

As used herein, term "antibody" is used generally. Antibodies described herein can take on a number of formats as described herein, including traditional antibodies as well as antibody derivatives, fragments and mimetics, including a number of bispecific formats described herein.

Traditional immunoglobulin (Ig) antibodies are "Y" shaped tetramers. Each tetramer is typically composed of two identical pairs of polypeptide chains, each pair having one "light chain" monomer (typically having a molecular weight of about 25 kDa) and one "heavy chain" monomer (typically having a molecular weight of about 50-70 kDa).

Other useful antibody formats include, but are not limited to, the 1+1 Fab-scFv-Fc format and 2+1 Fab-scFv-Fc antibody formats described herein and depicted in FIG. 15, as well as "mAb-Fv," "mAb-scFv," "central-Fv", "one-armed scFv-mAb," "scFv-mAb," "dual scFv," and "trident" format antibodies, as discussed below and shown in FIG. 44.

Antibody heavy chains typically include a variable heavy ($V_H$) domain, which includes vhCDR1-3, and an Fc domain, which includes a CH2-CH3 monomer. In some embodiments, antibody heavy chains include a hinge and CH1 domain. Traditional antibody heavy chains are monomers that are organized, from N- to C-terminus: $V_H$-CH1-hinge-CH2-CH3. The CH1-hinge-CH2-CH3 is collectively referred to as the heavy chain "constant domain" or "constant region" of the antibody, of which there are five different categories or "isotypes": IgA, IgD, IgG, IgE and IgM. Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the antibodies described herein include the use of human IgG1/ IgG2 hybrids.

In some embodiments, the antibodies provided herein include IgG isotype constant domains, which has several subclasses, including, but not limited to IgG1, IgG2, IgG3, and IgG4. In the IgG subclass of immunoglobulins, there are several immunoglobulin domains in the heavy chain. By "immunoglobulin (Ig) domain" herein is meant a region of an immunoglobulin having a distinct tertiary structure. Of interest in the antibodies described herein are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype. It should be understood that therapeutic antibodies can also comprise hybrids of isotypes and/or subclasses. For example, as shown in US Publication 2009/0163699, incorporated by reference, the present antibodies, in some embodiments, include IgG1/IgG2 hybrids.

By "Fc" or "Fc region" or "Fc domain" as used herein is meant the polypeptide comprising the constant region of an antibody, in some instances, excluding all of the first constant region immunoglobulin domain (e.g., CH1) or a portion thereof, and in some cases, optionally including all or part of the hinge. For IgG, the Fc domain comprises immunoglobulin domains CH2 and CH3 (Cγ2 and Cγ3), and optionally all or a portion of the hinge region between CH1 (Cγ1) and CH2 (Cγ2). Thus, in some cases, the Fc domain includes, from N- to C-terminal, CH2-CH3 and hinge-CH2-CH3. In some embodiments, the Fc domain is that from human IgG1, IgG2, IgG3 or IgG4, with human IgG1 hinge-CH2-CH3 and IgG4 hinge-CH2-CH3 finding particular use in many embodiments. Additionally, in the case of human IgG1 Fc domains, frequently the hinge includes a C220S amino acid substitution. Furthermore, in the case of human IgG4 Fc domains, frequently the hinge includes a S228P amino acid substitution. Although the boundaries of the Fc region may vary, the human IgG heavy chain Fc region is usually defined to include residues E216, C226, or A231 to its carboxyl-terminal, wherein the numbering is according to the EU index as in Kabat. In some embodiments, as is more fully described below, amino acid modifications are made to the Fc region, for example to alter binding to one or more FcγR or to the FcRn.

By "heavy chain constant region" herein is meant the CH1-hinge-CH2-CH3 portion of an antibody (or fragments thereof), excluding the variable heavy domain; in EU numbering of human IgG1 this is amino acids 118-447 By "heavy chain constant region fragment" herein is meant a heavy chain constant region that contains fewer amino acids from either or both of the N- and C-termini but still retains the ability to form a dimer with another heavy chain constant region.

Another type of Ig domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (p230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well. Many of the antibodies herein have at least one the cysteines at position 220 according to EU numbering (hinge region) replaced by a serine. Generally, this modification is on the "scFv monomer" side for most of the sequences depicted herein, although it can also be on the "Fab monomer" side, or both, to reduce disulfide formation. Specifically included within the sequences herein are one or both of these cysteines replaced (C220S).

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

|  | EU Numbering | Kabat Numbering |
|---|---|---|
| CH1 | 118-215 | 114-223 |
| Hinge | 216-230 | 226-243 |
| CH2 | 231-340 | 244-360 |
| CH3 | 341-447 | 361-478 |

The antibody light chain generally comprises two domains: the variable light domain (VL), which includes light chain CDRs vlCDR1-3, and a constant light chain region (often referred to as CL or ClO. The antibody light chain is typically organized from N- to C-terminus: VL-CL.

By "antigen binding domain" or "ABD" herein is meant a set of six Complementary Determining Regions (CDRs) that, when present as part of a polypeptide sequence, specifically binds a target antigen (e.g., GPC3 or CD3) as discussed herein. As is known in the art, these CDRs are generally present as a first set of variable heavy CDRs (vhCDRs or VHCDRs) and a second set of variable light CDRs (vlCDRs or VLCDRs), each comprising three CDRs: vhCDR1, vhCDR2, vhCDR3 variable heavy CDRs and vlCDR1, vlCDR2 and vlCDR3 vhCDR3 variable light CDRs. The CDRs are present in the variable heavy domain (vhCDR1-3) and variable light domain (vlCDR1-3). The variable heavy domain and variable light domain form an Fv region.

The antibodies described herein provide a large number of different CDR sets. In this case, a "full CDR set" comprises the three variable light and three variable heavy CDRs, e.g., a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g., vhCDR1, vhCDR2 and vhCDR3) and the disclosure of each variable light region is a disclosure of the vlCDRs (e.g., vlCDR1, vlCDR2 and vlCDR3). A useful comparison of CDR numbering is as below, see Lafranc et al., *Dev. Comp. Immunol.* 27(1):55-77 (2003):

TABLE 2

|  | Kabat + Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

The CDRs contribute to the formation of the antigen-binding, or more specifically, epitope binding site of the antigen binding domains and antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the disclosure not only includes the enumerated antigen binding domains and antibodies herein, but those that compete for binding with the epitopes bound by the enumerated antigen binding domains.

In some embodiments, the six CDRs of the antigen binding domain are contributed by a variable heavy and a variable light domain. In a "Fab" format, the set of 6 CDRs are contributed by two different polypeptide sequences, the variable heavy domain (vh or $V_H$; containing the vhCDR1, vhCDR2 and vhCDR3) and the variable light domain (vl or $V_L$; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker (a "scFv linker") as outlined herein, into a single polypeptide sequence, which can be either (starting from the N-terminus) vh-linker-vl or vl-linker-vh, with the former being generally preferred (including optional domain linkers on each side, depending on the format used (e.g., from FIG. 44). In general, the C-terminus of the scFv domain is attached to the N-terminus of the hinge in the second monomer.

By "variable region" or "variable domain" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively, and contains the CDRs that confer antigen specificity. Thus, a "variable heavy domain" pairs with a "variable light domain" to form an antigen binding domain ("ABD"). In addition, each variable domain comprises three hypervariable regions ("complementary determining regions," "CDRs") (VHCDR1, VHCDR2 and VHCDR3 for the variable heavy domain and VLCDR1, VLCDR2 and VLCDR3 for the variable light domain) and four framework (FR) regions, arranged from amino-terminus to carboxy-terminus in the following order: FR1-CDR1-FR2-CDR2-FR3-CDR3-FR4. The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described in Table 2.

By "Fab" or "Fab region" as used herein is meant the polypeptide that comprises the VH, CH1, VL, and CL immunoglobulin domains, generally on two different polypeptide chains (e.g. VH-CH1 on one chain and VL-CL on the other). Fab may refer to this region in isolation, or this region in the context of a bispecific antibody described herein. In the context of a Fab, the Fab comprises an Fv region in addition to the CH1 and CL domains.

By "Fv" or "Fv fragment" or "Fv region" as used herein is meant a polypeptide that comprises the VL and VH domains of an ABD. Fv regions can be formatted as both Fabs (as discussed above, generally two different polypeptides that also include the constant regions as outlined above) and scFvs, where the VL and VH domains are combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (VH-linker-VL or VL-linker-VH). In the sequences depicted in the sequence listing and in the figures, the order of the VH and VL domain is indicated in the name, e.g. H.X_L.Y means N- to C-terminal is VH-linker-VL, and L.Y_H.X is VL-linker-VH. However, the disclosure of any "H L" pairs is meant to include them in either order.

Some embodiments of the subject antibodies provided herein comprise at least one scFv domain, which, while not naturally occurring, generally includes a variable heavy domain and a variable light domain, linked together by a scFv linker. As outlined herein, while the scFv domain is generally from N- to C-terminus oriented as VH-scFv linker-VL, this can be reversed for any of the scFv domains (or those constructed using vh and vl sequences from Fabs), to VL-scFv linker-VH, with optional linkers at one or both ends depending on the format.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, −233E or 233E designates an insertion of glutamic acid after position 233 and before position 234. Additionally, −233ADE or A233ADE designates an insertion of AlaAsp-Glu after position 233 and before position 234.

By "amino acid deletion" or "deletion" as used herein is meant the removal of an amino acid sequence at a particular position in a parent polypeptide sequence. For example, E233- or E233 #, E233( ) or E233del designates a deletion of glutamic acid at position 233. Additionally, EDA233- or EDA233 # designates a deletion of the sequence GluAspAla that begins at position 233.

By "variant protein" or "protein variant", or "variant" as used herein is meant a protein that differs from that of a parent protein by virtue of at least one amino acid modification. The protein variant has at least one amino acid modification compared to the parent protein, yet not so many that the variant protein will not align with the parental protein using an alignment program such as that described below. In general, variant proteins (such as variant Fc domains, etc., outlined herein, are generally at least 75, 80, 85, 90, 91, 92, 93, 94, 95, 96, 97, 98 or 99% identical to the parent protein, using the alignment programs described below, such as BLAST. "Variant" as used herein also refers to particular amino acid modifications that confer particular function (e.g., a "heterodimerization variant," "pI variant," "ablation variant," etc.).

As described below, in some embodiments the parent polypeptide, for example an Fc parent polypeptide, is a human wild-type sequence, such as the heavy constant domain or Fc region from IgG1, IgG2, IgG3 or IgG4, although human sequences with variants can also serve as "parent polypeptides", for example the IgG1/2 hybrid of US Publication 2006/0134105 can be included. The protein variant sequence herein will preferably possess at least about 80% identity with a parent protein sequence, and most preferably at least about 90% identity, more preferably at least about 95-98-99% identity. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification.

"Fc variant" or "variant Fc" as used herein is meant a protein comprising an amino acid modification in an Fc domain. The modification can be an addition, deletion, or substitution. The Fc variants are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as 434S/428L, and so on. For all positions discussed herein that relate to antibodies or derivatives and fragments thereof (e.g., Fc domains), unless otherwise noted, amino acid position numbering is according to the EU index. The "EU index" or "EU index as in Kabat" or "EU numbering" scheme refers to the numbering of the EU antibody (Edelman et al., 1969, Proc Natl Acad Sci USA 63:78-85, hereby entirely incorporated by reference).

In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Alternatively, the variant Fc domains can have up to 1, 2, 3, 4, 5, 6, 7, 8, 9, 10, 11, 12, 13, 14, 15, 16, 11, 12, 13, 14, 15, 16, 17, 18, 19 or 20 amino acid modifications as compared to the parental Fc domain. Additionally, as discussed herein, the variant Fc domains described herein still retain the ability to form a dimer with another Fc domain as measured using known techniques as described herein, such as non-denaturing gel electrophoresis.

By "protein" herein is meant at least two covalently attached amino acids, which includes proteins, polypeptides, oligopeptides and peptides. In addition, polypeptides that make up the antibodies described herein may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the human IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. An "FcRn variant" is one that increases binding to the FcRn receptor, and suitable FcRn variants are shown below.

By "parent polypeptide" as used herein is meant a starting polypeptide that is subsequently modified to generate a variant. The parent polypeptide may be a naturally occurring polypeptide, or a variant or engineered version of a naturally occurring polypeptide. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below. In this context, a "parent Fc domain" will be relative to the recited variant; thus, a "variant human IgG1 Fc domain" is compared to the parent Fc domain of human IgG1, a "variant human IgG4 Fc domain" is compared to the parent Fc domain human IgG4, etc.

By "position" as used herein is meant a location in the sequence of a protein. Positions may be numbered sequentially, or according to an established format, for example the EU index for antibody numbering.

By "target antigen" as used herein is meant the molecule that is bound specifically by the antigen binding domain comprising the variable regions of a given antibody.

By "strandedness" in the context of the monomers of the heterodimeric antibodies described herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer one set of the pair will go, such that pI separation is maximized using the pI of the skews as well.

By "target cell" as used herein is meant a cell that expresses a target antigen.

By "host cell" in the context of producing a bispecific antibody according to the antibodies described herein is meant a cell that contains the exogenous nucleic acids encoding the components of the bispecific antibody and is capable of expressing the bispecific antibody under suitable conditions. Suitable host cells are discussed below.

By "wild type or WT" herein is meant an amino acid sequence or a nucleotide sequence that is found in nature, including allelic variations. A WT protein has an amino acid sequence or a nucleotide sequence that has not been intentionally modified.

Provided herein are a number of antibody domains that have sequence identity to human antibody domains. Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, C D. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see blast.ncbi.nlm.nih.gov. When using any of the aforementioned algorithms, the default parameters (for Window length, gap penalty, etc.) are used. In one embodiment, sequence identity is done using the BLAST algorithm, using default parameters The antibodies described herein are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogenous host cells, and they can be isolated as well.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore, SPR or BLI assay.

D. Antibodies of the Invention

The present invention provides antibodies, including monoclonal antibodies and bispecific antibodies, that bind to human GPC3 (it should be noted that many, if not most, of the exemplified antibodies also bind to cyno GPC3 for ease of pre-clinical testing, but this is not required in all embodiments). In particularly, bispecific antibodies are provided that bind CD3 and GPC3 that make take on a variety of formats as more fully described below.

1. Antibodies

The antibodies provided herein include different antibody domains as is more fully described below. As described herein and known in the art, the antibodies described herein include different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

In particular, the formats depicted in FIGS. 15A and 15B are antibodies, usually referred to as "heterodimeric antibodies", meaning that the protein has at least two associated Fc sequences self-assembled into a heterodimeric Fc domain and at least two Fv regions, whether as Fabs or as scFvs.

a. Chimeric and Humanized Antibodies

In certain embodiments, the antibodies described herein comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody (using the methods outlined herein). A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants described herein). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants described herein).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

2. Heterodimeric Antibodies

In exemplary embodiments, the bispecific antibodies provided herein are heterodimeric bispecific antibodies that include two variant Fc domain sequences. Such variant Fc domains include amino acid modifications to facilitate the self-assembly and/or purification of the heterodimeric antibodies.

An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in biasing the formation of the desired heterodimeric antibody over the formation of the homodimers and/or purifying the heterodimeric antibody away from the homodimers.

There are a number of mechanisms that can be used to generate the subject heterodimeric antibodies. In addition, as will be appreciated by those in the art, these different mechanisms can be combined to ensure high heterodimerization. Amino acid modifications that facilitate the production and purification of heterodimers are collectively referred to generally as "heterodimerization variants." As discussed below, heterodimerization variants include "skew" variants (e.g., the "knobs and holes" and the "charge pairs" variants described below) as well as "pI variants," which allow purification of heterodimers from homodimers. As is generally described in U.S. Pat. No. 9,605,084, hereby incorporated by reference in its entirety and specifically as below for the discussion of heterodimerization variants, useful mechanisms for heterodimerization include "knobs and holes" ("KIH") as described in U.S. Pat. No. 9,605,084, "electrostatic steering" or "charge pairs" as described in U.S. Pat. No. 9,605,084, pI variants as described in U.S. Pat. No. 9,605,084, and general additional Fc variants as outlined in U.S. Pat. No. 9,605,084 and below.

Heterodimerization variants that are useful for the formation and purification of the subject heterodimeric antibody (e.g., bispecific antibodies) are further discussed in detailed below.

a. Skew Variants

In some embodiments, the heterodimeric antibody includes skew variants which are one or more amino acid modifications in a first Fc domain (A) and/or a second Fc domain (B) that favor the formation of Fc heterodimers (Fc dimers that include the first and the second Fc domain; (A-B) over Fc homodimers (Fc dimers that include two of the first Fc domain or two of the second Fc domain; A-A or B-B). Suitable skew variants are included in the FIG. 29 of US Publ. App. No. 2016/0355608, hereby incorporated by reference in its entirety and specifically for its disclosure of skew variants, as well as in FIG. 1.

Thus, suitable Fc heterodimerization variant pairs that will permit the formation of heterodimeric Fc regions are shown in FIG. 1. Thus a first Fc domain has first Fc heterodimerization variants and the second Fc domain has second Fc heterodimerization variants selected from the pairs in FIG. 1.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

In some embodiments, the skew variants advantageously and simultaneously favor heterodimerization based on both the "knobs and holes" mechanism as well as the "electrostatic steering" mechanism. In some embodiments, the heterodimeric antibody includes one or more sets of such heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other. That is, these pairs of sets may instead form an interface between the two monomers that encourages heterodimer formation and discourages homodimer formation, allowing the percentage of heterodimers that spontaneously form under biological conditions to be over 90%, rather than the expected 50% (25 homodimer A/A:50% heterodimer A/B:25% homodimer B/B). Exemplary heterodimerization "skew" variants are depicted in FIG. 1. In exemplary embodiments, the heterodimeric antibody includes Fc heterodimerization variants as sets: S364K/E357Q: L368D/K370S; L368D/K370S: S364K; L368E/K370S: S364K; T411T/E360E/Q362E: D401K; L368D/K370S: S364K/E357L; K370S: S364K/E357Q; or a T366S/L368A/Y407V: T366W (optionally including a bridging disulfide, T366S/L368A/Y407V/Y349C: T366W/S354C) are all "skew" variant amino acid substitution sets of Fc heterodimerization variants. In an exemplary embodiment, the heterodimeric antibody includes a "S364K/E357Q: L368D/K370S" amino acid substitution set. In terms of nomenclature, the pair "S364K/E357Q: L368D/K370S" means that one of the monomers includes an Fc domain that includes the amino acid substitutions S364K and E357Q and the other monomer includes an Fc domain that includes the amino acid substitutions L368D and K370S; as above, the "strandedness" of these pairs depends on the starting pI.

In some embodiments, the skew variants provided herein can be optionally and independently incorporated with any other modifications, including, but not limited to, other skew variants (see, e.g., in FIG. 37 of US Publ. App. No. 2012/0149876, herein incorporated by reference, particularly for its disclosure of skew variants), pI variants, isotypic variants, FcRn variants, ablation variants, etc. into one or both of the first and second Fc domains of the heterodimeric antibody. Further, individual modifications can also independently and optionally be included or excluded from the subject the heterodimeric antibody.

Additional monomer A and monomer B variants that can be combined with other variants, optionally and independently in any amount, such as pI variants outlined herein or other steric variants that are shown in FIG. 37 of US 2012/0149876, the figure and legend and SEQ ID NOs of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the antibodies described herein.

A list of suitable skew variants is found in FIG. 1, which shows some pairs of particular utility in many embodiments.

Of particular use in many embodiments are the pairs of sets including, but not limited to, S364K/E357Q: L368D/K370S; L368D/K370S: S364K; L368E/K370S: S364K; T411T/E360E/Q362E: D401K; L368D/K370S: S364K/E357L and K370S: S364K/E357Q. In terms of nomenclature, the pair "S364K/E357Q: L368D/K370S" means that one of the monomers has the double variant set S364K/E357Q and the other has the double variant set L368D/K370S.

b. pI (Isoelectric Point) Variants for Heterodimers

In some embodiments, the heterodimeric antibody includes purification variants that advantageously allow for the separation of heterodimeric antibody (e.g., anti-GPC3× anti-CD3 bispecific antibody) from homodimeric proteins.

There are several basic mechanisms that can lead to ease of purifying heterodimeric antibodies. For example, modifications to one or both of the antibody heavy chain monomers A and B such that each monomer has a different pI allows for the isoelectric purification of heterodimeric A-B antibody from monomeric A-A and B-B proteins. Alternatively, some scaffold formats, such as the "1+1 Fab-scFv-Fc" format and the "2+1 Fab$_2$-scFv-Fc" format, also allows separation on the basis of size. As described above, it is also possible to "skew" the formation of heterodimers over homodimers using skew variants. Thus, a combination of heterodimerization skew variants and pI variants find particular use in the heterodimeric antibodies provided herein.

Additionally, as more fully outlined below, depending on the format of the heterodimeric antibody, pI variants either contained within the constant region and/or Fc domains of a monomer, and/or domain linkers can be used. In some embodiments, the heterodimeric antibody includes additional modifications for alternative functionalities that can also create pI changes, such as Fc, FcRn and KO variants.

In some embodiments, the subject heterodimeric antibodies provided herein include at least one monomer with one or more modifications that alter the pI of the monomer (i.e., a "pI variant"). In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Depending on the format of the heterodimer antibody, pI variants can be either contained within the constant and/or Fc domains of a monomer, or charged linkers, either domain linkers or scFv linkers, can be used. That is, antibody formats that utilize scFv(s) such as "1+1 Fab-scFv-Fc", format can include charged scFv linkers (either positive or negative), that give a further pI boost for purification purposes. As will be appreciated by those in the art, some 1+1 Fab-scFv-Fc formats are useful with just charged scFv linkers and no additional pI adjustments, although the antibodies described herein do provide pI variants that are on one or both of the monomers, and/or charged domain linkers as well. In addition, additional amino acid engineering for alternative functionalities may also confer pI changes, such as Fc, FcRn and KO variants.

In subject heterodimeric antibodies that utilizes pI as a separation mechanism to allow the purification of heterodimeric proteins, amino acid variants are introduced into one or both of the monomer polypeptides. That is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g., a neutral amino acid is replaced by a positively or negatively charged amino acid residue, e.g., glycine to glutamic acid), changing a charged residue from positive or negative to the opposite charge (aspartic acid to lysine) or changing a charged residue to a neutral residue (e.g., loss of a charge; lysine to serine). A number of these variants are shown in the FIGS. 1 and 2.

Thus, in some embodiments, the subject heterodimeric antibody includes amino acid modifications in the constant regions that alter the isoelectric point (pI) of at least one, if not both, of the monomers of a dimeric protein to form "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the antibodies described herein.

As will be appreciated by those in the art, the number of pI variants to be included on each or both monomer(s) to get good separation will depend in part on the starting pI of the components, for example in the 1+1 Fab-scFv-Fc and 2+1 Fab$_2$-scFv-Fc formats, the starting pI of the scFv and Fab(s) of interest. That is, to determine which monomer to engineer or in which "direction" (e.g., more positive or more negative), the Fv sequences of the two target antigens are calculated and a decision is made from there. As is known in the art, different Fvs will have different starting pIs which are exploited in the antibodies described herein. In general, as outlined herein, the pIs are engineered to result in a total pI difference of each monomer of at least about 0.1 logs, with 0.2 to 0.5 being preferred as outlined herein.

In the case where pI variants are used to achieve heterodimerization, by using the constant region(s) of the heavy chain(s), a more modular approach to designing and purifying bispecific proteins, including antibodies, is provided. Thus, in some embodiments, heterodimerization variants (including skew and pI heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g., the minimization or avoidance of non-human residues at any particular position. Alternatively or in addition to isotypic substitutions, the possibility of immunogenicity resulting from the pI variants is significantly reduced by utilizing isosteric substitutions (e.g. Asn to Asp; and Gln to Glu).

As discussed below, a side benefit that can occur with this pI engineering is also the extension of serum half-life and increased FcRn binding. That is, as described in US Publ. App. No. US 2012/0028304 (incorporated by reference in its entirety), lowering the pI of antibody constant domains (including those found in antibodies and Fc fusions) can lead to longer serum retention in vivo. These pI variants for increased serum half-life also facilitate pI changes for purification.

In addition, it should be noted that the pI variants give an additional benefit for the analytics and quality control process of bispecific antibodies, as the ability to either eliminate, minimize and distinguish when homodimers are present is significant. Similarly, the ability to reliably test the reproducibility of the heterodimeric antibody production is important.

In general, embodiments of particular use rely on sets of variants that include skew variants, which encourage heterodimerization formation over homodimerization formation, coupled with pI variants, which increase the pI difference between the two monomers to facilitate purification of heterodimers away from homodimers.

Exemplary combinations of pI variants are shown in FIGS. 1 and 2, and FIG. 30 of US Publ. App. No. 2016/0355608, all of which are herein incorporated by reference in its entirety and specifically for the disclosure of pI variants. Preferred combinations of pI variants are shown in FIGS. 1 and 2. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

Accordingly, in some embodiments, one monomer has a set of substitutions from FIG. 2 and the other monomer has a charged linker (either in the form of a charged scFv linker because that monomer comprises an scFv or a charged domain linker, as the format dictates, which can be selected from those depicted in FIGS. 5 and 6).

In some embodiments, modifications are made in the hinge of the Fc domain, including positions 216, 217, 218, 219, 220, 221, 222, 223, 224, 225, 226, 227, 228, 229, and 230 based on EU numbering. Thus, pI mutations and particularly substitutions can be made in one or more of positions 216-230, with 1, 2, 3, 4 or 5 mutations finding use. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339, based on EU numbering. It should be noted that changes in 233-236 can be made to increase effector function (along with 327A) in the IgG2 backbone. Again, all possible combinations of these 14 positions can be made; e.g., =may include a variant Fc domain with 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the modifications can be independently and optionally selected from position 355, 359, 362, 384, 389,392, 397, 418, 419, 444 and 447 (EU numbering) of the CH3 region. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447.

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 2. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, for example in the FIGS. 15 and 44 formats, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including (GKPGS)$_4$ (SEQ ID NO: 15). However, as will be appreciated by those in the art, the first monomer includes a CH1 domain, including position 208. Accordingly, in constructs that do not include a CH1 domain (for example for antibodies that do not utilize a CH1 domain on one of the domains, for example in a dual scFv format or a "one-armed" format such as those depicted in FIG. 44C or D), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 4 and the other monomer has a charged linker (either in the form of a charged scFv linker because that monomer comprises an scFv or a charged domain linker, as the format dictates, which can be selected from those depicted in FIGS. 5 and 6).

c. Isotypic Variants

In addition, many embodiments of the antibodies described herein rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

d. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

e. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, —7.4, induces the release of Fc back into the blood. In mice, Dall'Acqua et al. showed that Fc mutants with increased FcRn binding at pH 6 and pH 7.4 actually had reduced serum concentrations and the same half-life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

f. Additional Fc Variants for Additional Functionality

In addition to the heterodimerization variants discussed above, there are a number of useful Fc amino acid modification that can be made for a variety of reasons, including, but not limited to, altering binding to one or more FcγR receptors, altered binding to FcRn receptors, etc., as discussed below.

Accordingly, the antibodies provided herein (heterodimeric, as well as homodimeric) can include such amino acid modifications with or without the heterodimerization variants outlined herein (e.g., the pI variants and steric variants). Each set of variants can be independently and optionally included or excluded from any particular heterodimeric protein.

(i) FcγR Variants

Accordingly, there are a number of useful Fc substitutions that can be made to alter binding to one or more of the FcγR receptors. In certain embodiments, the subject antibody includes modifications that alter the binding to one or more FcγR receptors (i.e., "FcγR variants"). Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the antibodies described herein include those listed in U.S. Pat. No. 8,188,321 (particularly FIG. 41) and U.S. Pat. No. 8,084,582, and US Publ. App. Nos. 20060235208 and 20070148170, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D/332E/330L, 243A, 243L, 264A, 264V and 299T.

In addition, there are additional Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 428L/434A, 259I/308F, 436I/428L, 436I or V/434S, 436V/428L and 259I/308F/428L. Such modification may be included in one or both Fc domains of the subject antibody.

(ii) Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, particularly in the use of bispecific antibodies that bind CD3 monovalently it is generally desirable to ablate FcγRIIIa binding to eliminate or significantly reduce ADCC activity. wherein one of the Fc domains comprises one or more Fcγ receptor ablation variants. These ablation variants are depicted in FIG. 14, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

As is known in the art, the Fc domain of human IgG1 has the highest binding to the Fcγ receptors, and thus ablation variants can be used when the constant domain (or Fc domain) in the backbone of the heterodimeric antibody is IgG1. Alternatively, or in addition to ablation variants in an IgG1 background, mutations at the glycosylation position 297 (generally to A or S) can significantly ablate binding to FcγRIIIa, for example. Human IgG2 and IgG4 have naturally reduced binding to the Fcγ receptors, and thus those backbones can be used with or without the ablation variants.

E. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In some embodiments, the heterodimeric antibodies provided herein include the combination of heterodimerization skew variants, isosteric pI substitutions and FcKO variants as depicted in FIG. 4. In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

Exemplary combination of variants that are included in some embodiments of the heterodimeric 1+1 Fab-scFv-Fc and 2+1 Fab$_2$-scFv-Fc format antibodies are included in FIG. 4. In certain embodiments, the antibody is a heterodimeric 1+1 Fab-scFv-Fc or 2+1 Fab$_2$-scFv-Fc format antibody as shown in FIGS. 15A and 15B.

F. Anti-GPC3×Anti-CD3 Bispecific Antibodies

In another aspect, provided herein are anti-GPC3×anti-CD3 (also referred to herein as "αGPC3×αCD3" or sometimes just "GPC3×CD3") bispecific antibodies. Such antibodies include at least one GPC3 binding domain and at least one CD3 binding domain. In some embodiments, bispecific αGPC3×αCD3 provided herein immune responses selectively in tumor sites that express GPC3.

Note that unless specified herein, the order of the antigen list in the name does not confer structure; that is a GPC3× CD3 1+1 Fab-scFv-Fc antibody can have the scFv bind to GPC3 or CD3, although in some cases, the order specifies structure as indicated.

As is more fully outlined herein, these combinations of ABDs can be in a variety of formats, as outlined below, generally in combinations where one ABD is in a Fab format and the other is in an scFv format. Exemplary formats that are used in the bispecific antibodies provided herein include the 1+1 Fab-scFv-Fc and 2+1 Fab2-scFv-Fv formats (see, e.g., FIGS. 15A and 15B). Other useful antibody formats include, but are not limited to, "mAb-Fv," "mAb-scFv," "central-Fv", "one-armed scFv-mAb," "scFv-mAb," "dual scFv," and "trident" format antibodies, as depicted in FIG. 44 and more fully described below.

In addition, in general, one of the ABDs comprises a scFv as outlined herein, in an orientation from N- to C-terminus of VH-scFv linker-VL or VL-scFv linker-VH. One or both of the other ABDs, according to the format, generally is a Fab, comprising a VH domain on one protein chain (generally as a component of a heavy chain) and a VL on another protein chain (generally as a component of a light chain).

As will be appreciated by those in the art, any set of 6 CDRs or VH and VL domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 5 and FIG. 6.

In addition, as discussed above, the numbering used in the Sequence Listing for the identification of the CDRs is Kabat, however, different numbering can be used, which will change the amino acid sequences of the CDRs as shown in Table 2.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 or 90% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 or 90% identity to a human germline sequence selected from those listed in FIG. 1 of U.S. Pat. No. 7,657,380. Alternatively, the CDRs can have amino acid modifications (e.g., from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g., there may be one change in vlCDR1, two in vhCDR2, none in vhCDR3, etc.)), as well as having framework region changes, as long as the framework regions retain at least 80, 85 or 90% identity to a human germline sequence selected from those listed in FIG. 1 of U.S. Pat. No. 7,657,380.

As discussed herein, the subject heterodimeric antibodies include two antigen binding domains (ABDs), each of which bind to GPC3 or CD3. As outlined herein, these heterodimeric antibodies can be bispecific and bivalent (each antigen is bound by a single ABD, for example, in the format depicted in FIG. 15A), or bispecific and trivalent (one antigen is bound by a single ABD and the other is bound by two ABDs, for example as depicted in FIG. 15B).

In addition, in general, one of the ABDs comprises a scFv as outlined herein, in an orientation from N- to C-terminus of VH-scFv linker-VL or VL-scFv linker-VH. One or both of the other ABDs, according to the format, generally is a Fab, comprising a VH domain on one protein chain (generally as a component of a heavy chain) and a VL on another protein chain (generally as a component of a light chain).

The disclosure provides a number of ABDs as outlined below. As will be appreciated by those in the art, any set of 6 CDRs or VH and VL domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIG. 5.

In addition, as discussed above, the numbering used in the Sequence Listing for the identification of the CDRs is Kabat, however, different numbering can be used, which will change the amino acid sequences of the CDRs as shown in Table 2.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 or 90% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 or 90% identity to a human germline sequence selected from those listed in FIG. 1 of U.S. Pat. No. 7,657,380. Alternatively, the CDRs can have amino acid modifications (e.g. from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g. there may be one change in VLCDR1, two in VHCDR2, none in VHCDR3, etc.)), as well as having framework region changes, as long as the framework regions retain at least 80, 85 or 90% identity to a human germline sequence selected from those listed in FIG. 1 of U.S. Pat. No. 7,657,380.

1. GPC3 Antigen Binding Domains

Herein is provided monoclonal and bispecific antibodies that contain antigen binding domains that bind to human GPC3. Suitable sets of 6 CDRs and/or VH and VL domains are depicted in FIGS. 12 and 13. In some embodiments, the heterodimeric antibody is a 1+1 Fab-scFv-Fc or 2+1 Fab2-scFv-Fv format antibody (see, e.g., FIGS. 15A and 15B) although any of the formats outlined below can be utilized.

In some embodiments, the anti-GPC3 ABD has a set of vhCDRs selected from the vhCDR1, vhCDR2 and vhCDR3 sequences from a VH selected from the group consisting of H1, H1, H1.1, H1.2, H1.3 and H1.4 the sequences of which are shown in FIGS. 12 and 13.

In some embodiments, the VH domain of the anti-GPC3 ABD is selected from the group consisting of H1, H1, H1.1, H1.2, H1.3 and H1.4 the sequences of which are shown in FIGS. 12 and 13.

In some embodiments, the anti-GPC3 ABD has a set of vlCDRs selected from the vlCDR1, vlCDR2 and vlCDR3 sequences from a VL selected from the group consisting of L1, L1.1, L1.2, L1.3, L1.4, L1.5, L1.6, L1.7, L1.8, L1.9, L1.10, L1.16, L1.23, L1.29, L1.31. L1.65, L1.66, L1.68, L1.69, L1.70, L1.71, L1.72 and L1.73, the sequences of which are shown in FIGS. 12 and 13.

In some embodiments, the VL of the GPC3 ABD is selected from the group consisting of L1, L1.1, L1.2, L1.3, L1.4, L1.5, L1.6, L1.7, L1.8, L1.9, L1.10, L1.16, L1.23, L1.29, L1.31. L1.65, L1.66, L1.68, L1.69, L1.70, L1.71, L1.72 and L1.73, the sequences of which are shown in FIGS. 12 and 13.

Accordingly, included herein are GPC3 ABDs that have a set of 6 CDRs (vhCDR1, vhCDR2, vhCDR3, vlCDR1, vlCDR2 and vlCDR3) from $V_H/V_L$ pairs selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10, [GPC3]H1.1_L1.16, [GPC3]H1.1_L1.23, [GPC3]H1.1_L1.29, [GPC3]H1.1_L1.31, [GPC3]H1.1_L1.65, [GPC3]H1.1_L1.66, L1.67, [GPC3]H1.1_L1.68, [GPC3]H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3]H1.2_L1.29, [GPC3]H1.2_L1.31, [GPC3]H1.2_L1.65, [GPC3]H1.2_L1.66, [GPC3]H1.2_L1.67, [GPC3]H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]H1.3_L1.2, [GPC3]H1.3_L1.3, [GPC3]H1.3_L1.4, [GPC3]H1.3_L1.5, [GPC3]H1.3_L1.6, [GPC3]H1.3_L1.7, [GPC3]H1.3_L1.8, [GPC3]H1.3_L1.9, [GPC3]H1.3_L1.10, [GPC3]H1.3_L1.16, [GPC3]H1.3_L1.23, [GPC3]H1.3_L1.29, [GPC3]H1.3_L1.31, [GPC3]H1.3_L1.65, [GPC3]H1.3_L1.66, [GPC3]H1.3_L1.67, [GPC3]H1.3_L1.68, [GPC3]H1.3_L1.70, [GPC3]H1.3_L1.71, [GPC3]H1.3_L1.72, [GPC3]H1.3_L1.73, [GPC3]H1.4_L1, [GPC3]H1.4_L1.1, [GPC3]H1.4_L1.2, [GPC3]H1.4_L1.3, [GPC3]H1.4_L1.4, [GPC3]H1.4_L1.5, [GPC3]H1.4_L1.6, [GPC3]H1.4_L1.7, [GPC3]H1.4_L1.8, [GPC3]H1.4_L1.9, [GPC3]H1.4_L1.10, [GPC3]H1.4_L1.16, [GPC3]H1.4_L1.23, [GPC3]H1.4_L1.29, [GPC3]H1.4_L1.31, [GPC3]H1.4_L1.65, [GPC3]H1.4_L1.66, [GPC3]H1.4_L1.67, [GPC3]H1.4_L1.68, [GPC3]H1.4_L1.70, [GPC3]H1.4_L1.71, [GPC3]H1.4_L1.72 and [GPC3]H1.4_L1.73.

Additionally, included herein are GPC3 ABDs that have VH/VL pairs selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10, [GPC3]H1.1_L1.16, [GPC3]H1.1_L1.23, [GPC3]H1.1_L1.29, [GPC3]H1.1_L1.31, [GPC3]H1.1_L1.65, [GPC3]H1.1_L1.66, L1.67, [GPC3]H1.1_L1.68, [GPC3]H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3]H1.2_L1.29, [GPC3]H1.2_L1.31, [GPC3]H1.2_L1.65, [GPC3]H1.2_L1.66, [GPC3]H1.2_L1.67, [GPC3]H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]

H1.3_L1.2, [GPC3]H1.3_L1.3, [GPC3]H1.3_L1.4, [GPC3] H1.3_L1.5, [GPC3]H1.3_L1.6, [GPC3]H1.3_L1.7, [GPC3] H1.3_L1.8, [GPC3]H1.3_L1.9, [GPC3]H1.3_L1.10, [GPC3]H1.3_L1.16, [GPC3]H1.3_L1.23, [GPC3] H1.3_L1.29, [GPC3]H1.3_L1.31, [GPC3]H1.3_L1.65, [GPC3]H1.3_L1.66, [GPC3]H1.3_L1.67, [GPC3] H1.3_L1.68, [GPC3]H1.3_L1.70, [GPC3]H1.3_L1.71, [GPC3]H1.3_L1.72, [GPC3]H1.3_L1.73, [GPC3]H1.4_L1, [GPC3]H1.4_L1.1, [GPC3]H1.4_L1.2, [GPC3]H1.4_L1.3, [GPC3]H1.4_L1.4, [GPC3]H1.4_L1.5, [GPC3]H1.4_L1.6, [GPC3]H1.4_L1.7, [GPC3]H1.4_L1.8, [GPC3]H1.4_L1.9, [GPC3]H1.4_L1.10, [GPC3]H1.4_L1.16, [GPC3] H1.4_L1.23, [GPC3]H1.4_L1.29, [GPC3]H1.4_L1.31, [GPC3]H1.4_L1.65, [GPC3]H1.4_L1.66, [GPC3] H1.4_L1.67, [GPC3]H1.4_L1.68, [GPC3]H1.4_L1.70, [GPC3]H1.4_L1.71, [GPC3]H1.4_L1.72 and [GPC3] H1.4_L1.73.

In particular embodiments, the VH/VL pairs are selected from the group consisting of [GPC3]H1.1_L1.16 and [GPC3]H1.1_L1.69.

In particular embodiments, the VH/VL pairs are Fabs and are selected from the group consisting of [GPC3] H1.1_L1.16 and [GPC3]H1.1_L1.69.

As will be appreciated by those in the art, suitable GPC3 binding domains can comprise a set of 6 CDRs as depicted in the Figures, either as they are underlined or, in the case where a different numbering scheme is used as described herein and as shown in Table 2, as the CDRs that are identified using other alignments within the VH and VL sequences of those depicted in FIGS. 12 and 13. Suitable ABDs can also include the entire VH and VL sequences as depicted in these sequences and Figures, used as scFvs or as Fabs. In many of the embodiments herein that contain an Fv to GPC3, it is the Fab monomer that binds GPC3.

In addition to the parental CDR sets disclosed in the figures and sequence listing that form an ABD to GPC3, provided herein are variant GPC3 ABDs having CDRs that include at least one modification of the GPC3 ABD CDRs disclosed herein (e.g., (FIGS. 12 and 13 and the sequence listing). In one embodiment, the GPC3 ABD of the subject heterodimeric antibody includes a set of 6 CDRs with 1, 2, 3, 4, 5, 6, 7, 8, 9, 10 amino acid modifications as compared to the 6 CDRs of a GPC3 binding domain VH/VL pair as described herein, including the figures and sequence listing. In exemplary embodiments, the GPC3 ABD of the subject heterodimeric antibody includes a set of 6 CDRs with 1, 2, 3, 4, 5, 6, 7, 8, 9, 10 amino acid modifications as compared to the 6 CDRs of one of the following GPC3 binding domain [GPC3]H1.1_L1.16 and [GPC3]H1.1_L1.69. In certain embodiments, the GPC3 ABD of the subject antibody is capable of binding to GPC3, as measured at least one of a Biacore, surface plasmon resonance (SPR), BLI (biolayer interferometry, e.g., Octet assay) assay, and/or flow cytometry, with the latter finding particular use in many embodiments. In particular embodiments, the GPC3 ABD is capable of binding human GPC3 (see FIG. 11). In some cases, each variant CDR has no more than 1 or 2 amino acid changes, with no more than 1 per CDR being particularly useful.

In some embodiments, the GPC3 ABD of the subject antibody includes 6 CDRs that are at least 90, 95, 97, 98 or 99% identical to the 6 CDRs of a GPC3 ABD as described herein, including the figures and sequence listing. In exemplary embodiments, the GPC3 ABD of the subject antibody includes 6 CDRs that are at least 90, 95, 97, 98 or 99% identical to the 6 CDRs of one of the following GPC3 binding domain VH/VL pairs: GPC3]H1.1_L1.16 and [GPC3]H1.1_L1.69. In certain embodiments, the GPC3 ABD of the subject antibody is capable of binding to GPC3, as measured at least one of a Biacore, surface plasmon resonance (SPR), BLI (biolayer interferometry, e.g., Octet assay), and/or flow cytometry. In particular embodiments, the GPC3 ABD is capable of binding human GPC3 antigen (see FIG. 11).

In another exemplary embodiment, the GPC3 ABD of the subject antibody includes the variable heavy (VH) domain and variable light (VL) domain of any one of the GPC3 binding domain VH/VL pairs described herein, including the figures and sequence listing (e.g., FIGS. 12 and 13).

In some embodiments, the subject antibody includes a GPC3 ABD that includes a variable heavy domain and/or a variable light domain that are variants of a GPC3 ABD VH and VL domain disclosed herein. In one embodiment, the variant VH domain and/or VL domain has from 1, 2, 3, 4, 5, 6, 7, 8, 9 or 10 amino acid changes from a VH and/or VL domain of a GPC3 ABD described herein, including the figures and sequence listing. In exemplary embodiments, the variant VH domain and/or VL domain has from 1, 2, 3, 4, 5, 6, 7, 8, 9 or 10 amino acid changes from a VH and/or VL domain of one of the following GPC3 binding domain VH/VL pairs: GPC3]H1.1_L1.16 and [GPC3]H1.1_L1.69. In some embodiments, the changes are in a VH domain depicted in FIGS. 12 and 13. In some embodiments, the changes are in a VL domain are depicted in FIGS. 12 and 13. In some embodiments, the changes are in a VH and VL domain are depicted in FIGS. 12 and 13. In some embodiments, one or more amino acid changes are in the VH and/or VL framework regions (FR1, FR2, FR3, and/or FR4). In some embodiments, one or more amino acid changes are in one or more CDRs. In certain embodiments, the GPC3 ABD of the subject antibody is capable of binding to GPC3, as measured at least one of a Biacore, surface plasmon resonance (SPR), BLI (biolayer interferometry, e.g., Octet assay) assay, and/or flow cytometry. In particular embodiments, the GPC3 ABD is capable of binding human GPC3 antigen (see FIG. 11).

In one embodiment, the variant VH and/or VL domain is at least 90, 95, 97, 98 or 99% identical to the VH and/or VL of a GPC3 ABD as described herein, including the figures and sequence listing. In exemplary embodiments, the variant VH and/or VL domain is at least 90, 95, 97, 98 or 99% identical to the VH and/or VL of one of the following GPC3 binding domain VH/VL pairs: GPC3]H1.1_L1.16 and [GPC3]H1.1_L1.69. In some embodiments, the GPC3 ABD includes a VH that is at least 90, 95, 97, 98 or 99% identical to VH domain depicted in FIGS. 12 and 13. In some embodiments, the GPC3 ABD includes a VL that is at least 90, 95, 97, 98 or 99% identical to VL domain depicted in FIGS. 12 and 13. In some embodiments, the GPC3 ABD includes a VH and a VL that is at least 90, 95, 97, 98 or 99% identical to a VH domain and a VL domain depicted in FIGS. 12 and 13. In certain embodiments, the GPC3 ABD of the subject antibody is capable of binding to GPC3, as measured at least one of a Biacore, surface plasmon resonance (SPR), BLI (biolayer interferometry, e.g., Octet assay) assay, and/or flow cytometry. In particular embodiments, the GPC3 ABD is capable of binding human GPC3 antigen (see FIG. 11).

2. CD3 Antigen Binding Domains

The heterodimeric bispecific of the invention (e.g., anti-GPC3×anti-CD3 antibodies) also include an ABD that binds to human episilon CD3 (CDR).

Suitable sets of 6 CDRs and/or VH and VL domains, as well as scFv sequences, are depicted in FIG. 10. CD3 binding domain sequences that are of particular use include, but are not limited to, anti-CD3_H1.30_L1.47, anti-CD3_H1.32_L1.47, anti-CD3 H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3_L1.47_H1.90, anti-CD3_L1.47_H1.33, and anti-CD3_L1.47_H1.31 as depicted in FIG. 10. As shown in FIG. 10, when the anti-CD3 ABD is a scFv domain, the VH and VL domains can be in either orientation.

As will be appreciated by those in the art, suitable CD3 binding domains can comprise a set of 6 CDRs as depicted in FIG. 10, either as they are underlined or, in the case where a different numbering scheme is used as described herein and as shown in Table 2, as the CDRs that are identified using other alignments within the VH and VL sequences of those depicted in FIGS. 10A-10F. Suitable ABDs can also include the entire VH and VL sequences as depicted in these sequences and Figures, used as scFvs or as Fabs. In many of the embodiments herein that contain an Fv to CD3, it is the scFv monomer that binds CD3.

In addition to the parental CDR sets disclosed in the figures and sequence listing that form an ABD to CD3, provided herein are variant CD3 ABDS having CDRs that include at least one modification of the CD3 ABD CDRs disclosed herein (e.g., (FIG. 10 and the sequence listing). In one embodiment, the CD3 ABD of the subject heterodimeric antibody (e.g., anti-GPC3×anti-CD3 antibody) includes a set of 6 CDRs with 1, 2, 3, 4, 5, 6, 7, 8, 9, 10 amino acid modifications as compared to the 6 CDRs of a CD3 ABD as described herein, including the figures and sequence listing. In exemplary embodiments, the CD3 ABD of the subject heterodimeric antibody includes a set of 6 CDRs with 1, 2, 3, 4, 5, 6, 7, 8, 9, 10 amino acid modifications as compared to the 6 CDRs of one of the following CD3 binding domains: anti-CD3_H1.30_L1.47, anti-CD3_H1.32_L1.47, anti-CD3_H1.89_L1.47, anti-CD3 H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3_L1.47_H1.90, anti-CD3_L1.47_H1.33, and anti-CD3_L1.47_H1.31 (FIG. 10). In certain embodiments, the CD3 ABD of the subject antibody is capable of binding CD3 antigen, as measured by at least one of a Biacore, surface plasmon resonance (SPR), flow cytometry, and/or BLI (biolayer interferometry, e.g., Octet assay) assay, with the latter finding particular use in many embodiments. In particular embodiments, the CD3 ABD is capable of binding human CD3.

In some embodiments, the CD3 ABD of the subject antibody includes 6 CDRs that are at least 90, 95, 97, 98 or 99% identical to the 6 CDRs of a CD3 ABD as described herein, including the figures and sequence listing. In exemplary embodiments, the CD3 ABD of the subject antibody includes 6 CDRs that are at least 90, 95, 97, 98 or 99% identical to the 6 CDRs of one of the following CD3 binding domains: anti-CD3_H1.30_L1.47, anti-CD3 H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3_L1.47_H1.90, anti-CD3_L1.47_H1.33, and anti-CD3 L1.47_H1.31 (FIG. 10). In certain embodiments, the CD3 ABD is capable of binding to the CD3, as measured by at least one of a Biacore, surface plasmon resonance (SPR), flow cytometry, and/or BLI (biolayer interferometry, e.g., Octet assay) assay, with the latter finding particular use in many embodiments. In particular embodiments, the CD3 ABD is capable of binding human CD3 antigen.

In another exemplary embodiment, the CD3 ABD of the subject antibody includes the variable heavy (VH) domain and variable light (VL) domain of any one of the CD3 binding domains described herein, including the figures and sequence listing.

In some embodiments, the subject antibody includes a CD3 ABD that includes a variable heavy domain and/or a variable light domain that are variants of a CD3 ABD VH and VL domain disclosed herein. In one embodiment, the variant VH domain and/or VL domain has from 1, 2, 3, 4, 5, 6, 7, 8, 9 or 10 amino acid changes from a VH and/or VL domain of a CD3 ABD described herein, including the figures and sequence listing. In exemplary embodiments, the variant VH domain and/or VL domain has from 1, 2, 3, 4, 5, 6, 7, 8, 9 or 10 amino acid changes from a VH and/or VL domain of one of the following CD3 binding domains: anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3 L1.47_H1.30, anti-CD3_L1.47_H1.30, anti-CD3_L1.47_H1.32, anti-CD3_L1.47_H1.89, anti-CD3_L1.47_H1.90, anti-CD3_L1.47_H1.33, and anti-CD3_L1.47_H1.31 (FIG. 10). In some embodiments, the changes are in a VH domain depicted in FIG. 10. In some embodiments, the changes are in a VL domain are depicted in FIG. 10. In some embodiments, the changes are in a VH and VL domain are depicted in FIG. 10. In some embodiments, one or more amino acid changes are in the VH and/or VL framework regions (FR1, FR2, FR3, and/or FR4). In some embodiments, one or more amino acid changes are in one or more CDRs. In certain embodiments, the CD3 ABD of the subject antibody is capable of binding to CD3, as measured at least one of a Biacore, surface plasmon resonance (SPR), flow cytometry, and/or BLI (biolayer interferometry, e.g., Octet assay) assay, with the latter finding particular use in many embodiments. In particular embodiments, the CD3 ABD is capable of binding human CD3 antigen.

In one embodiment, the variant VH and/or VL domain is at least 90, 95, 97, 98 or 99% identical to the VH and/or VL of a CD3 ABD as described herein, including the figures and sequence listing. In exemplary embodiments, the variant VH and/or VL domain is at least 90, 95, 97, 98 or 99% identical to the VH and/or VL of one of the following CD3 binding domains: anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3 L1.47_H1.30, anti-CD3_L1.47_H1.30, anti-CD3_L1.47_H1.32, anti-CD3_L1.47_H1.89, anti-CD3_L1.47_H1.90, anti-CD3_L1.47_H1.33, and anti-CD3_L1.47_H1.31 (FIG. 10). In some embodiments, the CD3 ABD includes a VH that is at least 90, 95, 97, 98 or 99% identical to VH domain depicted in FIG. 10. In some embodiments, the CD3 ABD includes a VL that is at least 90, 95, 97, 98 or 99% identical to VL domain depicted in FIG. 10. In some embodiments, the CD3 ABD includes a VH and a VL that is at least 90, 95, 97, 98 or 99% identical to a VH domain and a VL domain depicted in FIG. 10. In certain embodiments, the CD3 ABD is capable of binding to CD3, as measured by at least one of a Biacore, surface plasmon resonance (SPR), flow cytometry, and/or BLI (biolayer interferometry, e.g., Octet assay) assay, with the latter finding particular use in many embodiments. In particular embodiments, the CD3 ABD is capable of binding human CD3 antigen.

In addition to the αCD3 ABDs of FIG. 10, additional ABDs of use in the invention include those depicted in FIGS. 14 and 15 of WO2014/145806, hereby expressly incorporated herein in their entirety including the Figures and Legends therein.

3. Linkers

As shown herein, there are a number of suitable linkers (for use as either domain linkers or scFv linkers) that can be used to covalently attach the recited domains (e.g., scFvs, Fabs, Fc domains, etc.), including traditional peptide bonds, generated by recombinant techniques. Exemplary linkers to attach domains of the subject antibody to each other are depicted in FIG. 6. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 3), (GGGGS)n (SEQ ID NO: 2), and (GGGS)n (SEQ ID NO: 4), where n is an integer of at least one (and generally from 3 to 4), glycine-alanine polymers, alanine-serine polymers, and other flexible linkers, some of which are shown in FIG. 5 and FIG. 6. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

In some embodiments, the linker is a "domain linker", used to link any two domains as outlined herein together. For example, in FIG. 15B, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n (SEQ ID NO: 3), (GGGGS)n (SEQ ID NO: 2), and (GGGS)n (SEQ ID NO: 4), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used. Exemplary useful domain linkers are depicted in FIG. 6.

With particular reference to the domain linker used to attach the scFv domain to the Fc domain in the "2+1" format, there are several domain linkers that find particular use, including "full hinge C220S variant," "flex half hinge," "charged half hinge 1," and "charged half hinge 2" as shown in FIG. 6.

In some embodiments, the linker is a "scFv linker", used to covalently attach the VH and VL domains as discussed herein. In many cases, the scFv linker is a charged scFv linker, a number of which are shown in FIG. 5. Accordingly, in some embodiments, the antibodies described herein further provide charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make 1+1 Fab-scFv-Fc format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the antibodies described herein as well, and thus those included in FIG. 5 can be used in any embodiment herein where a linker is utilized.

G. Useful Formats of the Invention

As will be appreciated by those in the art and discussed more fully below, the heterodimeric bispecific antibodies provided herein can take on a wide variety of configurations, as are generally depicted in FIG. 15 as well as FIG. 44. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Thus, in some embodiments, the antibodies described herein are directed to novel immunoglobulin compositions that co-engage a different first and a second antigen.

As will be appreciated by those in the art, the heterodimeric formats of the antibodies described herein can have different valencies as well as be bispecific. That is, heterodimeric antibodies of the antibodies described herein can be bivalent and bispecific, wherein one target tumor antigen (e.g. CD3) is bound by one binding domain and the other target tumor antigen (e.g. GPC3) is bound by a second binding domain. The heterodimeric antibodies can also be trivalent and bispecific, wherein the first antigen is bound by two binding domains and the second antigen by a second binding domain. As is outlined herein, when CD3 is one of the target antigens, it is preferable that the CD3 is bound only monovalently, to reduce potential side effects.

The antibodies described herein utilize anti-CD3 antigen binding domains in combination with anti-GPC3 binding domains. As will be appreciated by those in the art, any collection of anti-CD3 CDRs, anti-CD3 variable light and variable heavy domains, Fabs and scFvs as depicted in any of the Figures can be used. Similarly, any of the anti-GPC3 antigen binding domains can be used, whether CDRs, variable light and variable heavy domains, Fabs and scFvs as depicted in any of the Figures can be used, optionally and independently combined in any combination.

1. 1+1 Fab-scFv-Fc Format

One heterodimeric scaffold that finds particular use in the antibodies described herein is the "1+1 Fab-scFv-Fc" or "bottle-opener" format as shown in FIG. 15A with an exemplary combination of a CD3 binding domain and a tumor target antigen (GPC3) binding domain. In this embodiment, one heavy chain monomer of the antibody contains a single chain Fv ("scFv", as defined below) and an Fc domain. The scFv includes a variable heavy domain (VH1) and a variable light domain (VL1), wherein the VH1 is attached to the VL1 using an scFv linker that can be charged (see, e.g., FIG. 5). The scFv is attached to the heavy chain using a domain linker (see, e.g., FIG. 6). The other heavy chain monomer is a "regular" heavy chain (VH-CH1-hinge-CH2-CH3). The 1+1 Fab-scFv-Fc also includes a light chain that interacts with the VH-CH1 to form a Fab. This structure is sometimes referred to herein as the "bottle-opener" format, due to a rough visual similarity to a bottle-opener. The two heavy chain monomers are brought together by the use of amino acid variants (e.g., heterodimerization variants, discussed above) in the constant regions (e.g., the Fc domain, the CH1 domain and/or the hinge region) that promote the formation of heterodimeric antibodies as is described more fully below.

There are several distinct advantages to the present "1+1 Fab-scFv-Fc" format. As is known in the art, antibody analogs relying on two scFv constructs often have stability and aggregation problems, which can be alleviated in the antibodies described herein by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.).

Many of the embodiments outlined herein rely in general on the 1+1 Fab-scFv-Fc or "bottle opener" format antibody that comprises a first monomer comprising an scFv, comprising a variable heavy and a variable light domain, covalently attached using an scFv linker (charged, in many but not all instances), where the scFv is covalently attached to the N-terminus of a first Fc domain usually through a domain linker The domain linker can be either charged or uncharged and exogenous or endogenous (e.g., all or part of the native hinge domain). Any suitable linker can be used to attach the scFv to the N-terminus of the first Fc domain. In some embodiments, the domain linker is chosen from the domain linkers in FIG. 6. The second monomer of the 1+1 Fab-scFv-Fc format or "bottle opener" format is a heavy chain, and the composition further comprises a light chain.

In general, in many preferred embodiments, the scFv is the domain that binds to the CD3, and the Fab forms an GPC3 binding domain. An exemplary anti-GPC3×anti-CD3 bispecific antibody in the 1+1 Fab-scFv-Fc format is depicted in FIG. 15A. Exemplary anti-GPC3×anti-CD3 bispecific antibodies in the 1+1 Fab-scFv-Fc format are depicted in FIGS. 16 and 17.

In addition, the Fc domains of the antibodies described herein generally include skew variants (e.g. a set of amino acid substitutions as shown in FIG. 1, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357Q; K370S: S364K/E357Q; T366S/L368A/Y407V: T366W and T366S/L368A/Y407V/Y349C: T366W/S354C), optionally ablation variants (including those shown in FIG. 3), optionally charged scFv linkers (including those shown in FIG. 5) and the heavy chain comprises pI variants (including those shown in FIG. 2).

In certain embodiments, the 1+1 Fab-scFv-Fc scaffold format includes a first monomer that includes a scFv-domain linker-CH2-CH3 monomer, a second monomer that includes a first variable heavy domain-CH1-hinge-CH2-CH3 monomer and a third monomer that includes a first variable light domain. In some embodiments, the CH2-CH3 of the first monomer is a first variant Fc domain and the CH2-CH3 of the second monomer is a second variant Fc domain. In some embodiments, the scFv includes a scFv variable heavy domain and a scFv variable light domain that form a CD3 binding moiety. In certain embodiments, the scFv variable heavy domain and scFv variable light domain are covalently attached using an scFv linker (charged, in many but not all instances. See, e.g., FIG. 5). In some embodiments, the first variable heavy domain and first variable light domain form a GPC3 binding domain.

In some embodiments, the 1+1 Fab-scFv-Fc format includes skew variants, pI variants, and ablation variants. Accordingly, some embodiments include 1+1 Fab-scFv-Fc formats that comprise: a) a first monomer (the "scFv monomer") that comprises a charged scFv linker (with the +H sequence of FIG. 5 being preferred in some embodiments), the skew variants S364K/E357Q, the ablation variants E233P/L234V/L235A/G236del/S267K, and an scFv that binds to CD3 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain; and c) a light chain that includes a variable light domain light domain ($V_L$) and a constant light domain (CL), wherein numbering is according to EU numbering. The variable heavy domain and variable light domain make up an GPC3 binding moiety.

Any suitable CD3 ABD can be included in the 1+1 Fab-scFv-Fc format antibody, included those provided herein. CD3 binding domain sequences finding particular use in these embodiments include, but are not limited to, H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31 or a variant thereof, as well as those depicted in FIG. 10 and those depicted in FIGS. 14 and 15 of WO2014/145806, hereby incorporated by reference including the Legends.

Any suitable GPC3 ABD can be included in the 1+1 Fab-scFv-Fc format antibody, included those provided herein. GPC3 ABDs that are of particular use in these embodiments include, but are not limited to, VH and VL domains selected from have VH/VL pairs selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10, [GPC3] H1.1_L1.16, [GPC3]H1.1_L1.23, [GPC3]H1.1_L1.29, [GPC3]H1.1_L1.31, [GPC3]H1.1_L1.65, [GPC3] H1.1_L1.66, L1.67, [GPC3]H1.1_L1.68, [GPC3]

H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3] H1.2_L1.29, [GPC3]H1.2_L1.31, [GPC3]H1.2_L1.65, [GPC3]H1.2_L1.66, [GPC3]H1.2_L1.67, [GPC3] H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]H1.3_L1.2, [GPC3]H1.3_L1.3, [GPC3]H1.3_L1.4, [GPC3]H1.3_L1.5, [GPC3]H1.3_L1.6, [GPC3]H1.3_L1.7, [GPC3]H1.3_L1.8, [GPC3]H1.3_L1.9, [GPC3]H1.3_L1.10, [GPC3]H1.3_L1.16, [GPC3] H1.3_L1.23, [GPC3]H1.3_L1.29, [GPC3]H1.3_L1.31, [GPC3]H1.3_L1.65, [GPC3]H1.3_L1.66, [GPC3] H1.3_L1.67, [GPC3]H1.3_L1.68, [GPC3]H1.3_L1.70, [GPC3]H1.3_L1.71, [GPC3]H1.3_L1.72, [GPC3] H1.3_L1.73, [GPC3]H1.4_L1, [GPC3]H1.4_L1.1, [GPC3] H1.4_L1.2, [GPC3]H1.4_L1.3, [GPC3]H1.4_L1.4, [GPC3] H1.4_L1.5, [GPC3]H1.4_L1.6, [GPC3]H1.4_L1.7, [GPC3] H1.4_L1.8, [GPC3]H1.4_L1.9, [GPC3]H1.4_L1.10, [GPC3]H1.4_L1.16, [GPC3]H1.4_L1.23, [GPC3] H1.4_L1.29, [GPC3]H1.4_L1.31, [GPC3]H1.4_L1.65, [GPC3]H1.4_L1.66, [GPC3]H1.4_L1.67, [GPC3] H1.4_L1.68, [GPC3]H1.4_L1.70, [GPC3]H1.4_L1.71, [GPC3]H1.4_L1.72 and [GPC3]H1.4_L1.73 or a variant thereof.

In particular embodiments, the VH/VL pairs are selected from the group consisting of [GPC3]H1.1_L1.16 and [GPC3]H1.1_L1.69 or a variant thereof.

In some embodiments, the 1+1 Fab-scFv-Fc format includes skew variants, pI variants, ablation variants and FcRn variants. Accordingly, some embodiments include 1+1 Fab-scFv-Fc formats that comprise: a) a first monomer (the "scFv monomer") that comprises a charged scFv linker (with the +H sequence of FIG. 5 being preferred in some embodiments), the skew variants S364K/E357Q, the ablation variants E233P/L234V/L235A/G236del/S267K, the FcRn variants M428L/N434S and an scFv that binds to CD3 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S, and a variable heavy domain; and c) a light chain that includes a variable light domain (VL) and a constant light domain (CL), wherein numbering is according to EU numbering. The variable heavy domain and variable light domain make up a GPC3 binding domain. CD3 binding domain sequences finding particular use in these embodiments include, but are not limited to, H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31 or a variant thereof, as well as those depicted in FIG. 10. GPC3 binding domain sequences that are of particular use in these embodiments include, but are not limited to, the αGPC3 ABD VH/VL pairs are selected from the group consisting of [GPC3]H1.1_L1.16 and [GPC3]H1.1_L1.69.

Particularly useful GPC3 and CD3 sequence combinations for use with the 1+1 format antibody include, for example, are disclosed in FIGS. 16 and 17.

FIGS. 7A-7D show some exemplary Fc domain sequences that are useful in the 1+1 Fab-scFv-Fc format antibodies. The "monomer 1" sequences depicted in FIGS. 7A-7D typically refer to the Fc domain of the "Fab-Fc heavy chain" and the "monomer 2" sequences refer to the Fc domain of the "scFv-Fc heavy chain." Further, FIG. 9 provides useful CL sequences that can be used with this format.

In some embodiments, any of the VH and VL sequences depicted herein (including all VH and VL sequences depicted in the Figures and Sequence Listings, including those directed to GPC3) can be added to the bottle opener backbone formats of FIG. 7A-7D as the "Fab side", using any of the anti-CD3 scFv sequences shown in the Figures and Sequence Listings.

For bottle opener backbone 1 from FIG. 7A, (optionally including the 428L/434S variants), CD binding domain sequences finding particular use in these embodiments include, but are not limited to, CD3 binding domain anti-CD3 H1.30_L1.47, anti-CD3_H1.32_L1.47, anti-CD3_H1.89_L1.47, anti-CD3_H1.90_L1.47, anti-CD3 H1.33_L1.47 and anti-CD3_H1.31_L1.47 attached as the scFv side of the backbones shown in FIG. 7.

2. mAb-Fv

Figure 44A:
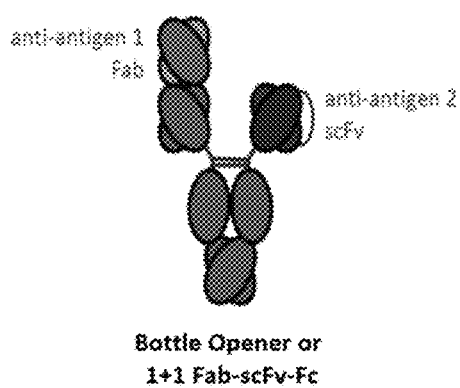
Figure 44B:
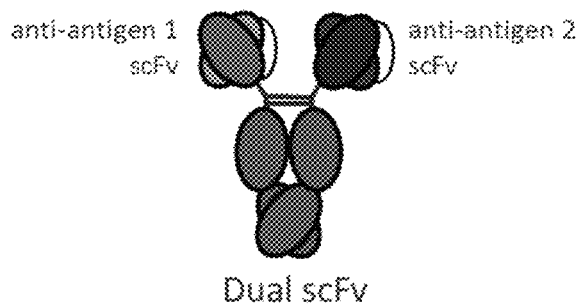
Figure 44C:
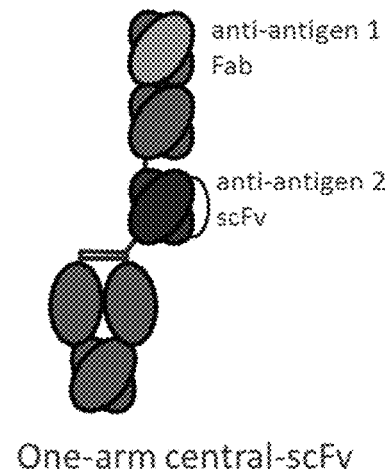
Figure 44D:
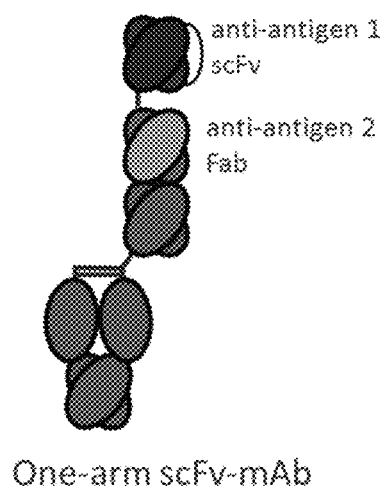
Figure 44E:
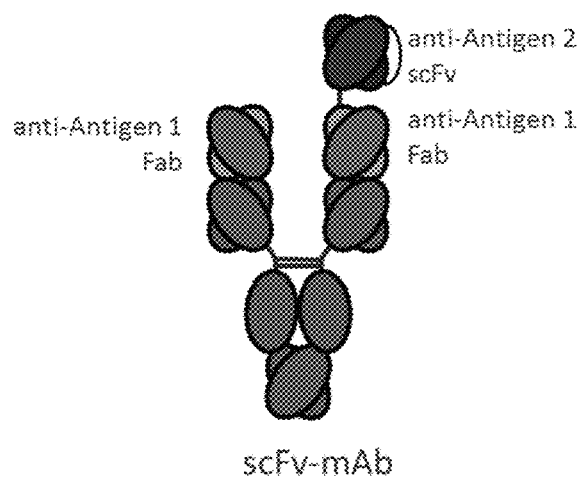
Figure 44F:
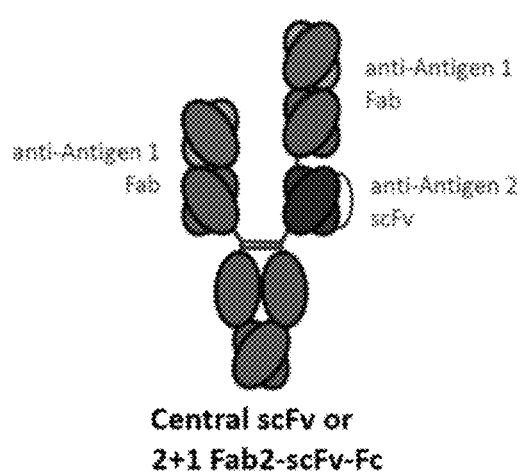
Figure 44G:
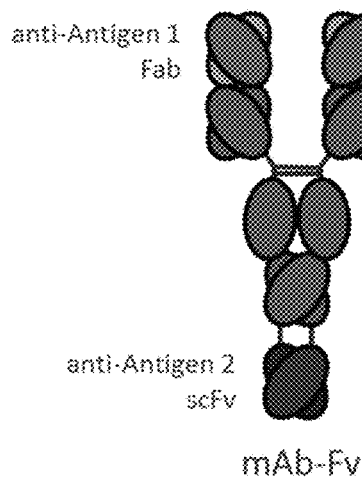

One heterodimeric scaffold that finds particular use in the antibodies described herein is the mAb-Fv format (FIG. 44G). In this embodiment, the format relies on the use of a C-terminal attachment of an "extra" variable heavy domain to one monomer and the C-terminal attachment of an "extra" variable light domain to the other monomer, thus forming a third antigen binding domain, wherein the Fab portions of the two monomers bind a GPC3 and the "extra" scFv domain binds CD3.

In this embodiment, the first monomer comprises a first heavy chain, comprising a first variable heavy domain and a first constant heavy domain comprising a first Fc domain, with a first variable light domain covalently attached to the C-terminus of the first Fc domain using a domain linker (VH1-CH1-hinge-CH2-CH3-[optional linker]-VL2). The second monomer comprises a second variable heavy domain of the second constant heavy domain comprising a second Fc domain, and a third variable heavy domain covalently attached to the C-terminus of the second Fc domain using a domain linker (vh1-CH1-hinge-CH2-CH3-[optional linker]-VH2. The two C-terminally attached variable domains make up a Fv that binds CD3 (as it is less preferred to have bivalent CD3 binding). This embodiment further utilizes a common light chain comprising a variable light domain and a constant light domain that associates with the heavy chains to form two identical Fabs that bind a GPC3. As for many of the embodiments herein, these constructs include skew variants, pI variants, ablation variants, additional Fc variants, etc. as desired and described herein.

The antibodies described herein provide mAb-Fv formats where the CD3 binding domain sequences are as shown in FIG. 10 or a variant thereof. The antibodies described herein provide mAb-Fv formats wherein the GPC3 binding domain sequences are as shown in FIGS. 12 and 13 or a variant thereof.

In addition, the Fc domains of the mAb-Fv format comprise skew variants (e.g. a set of amino acid substitutions as shown in FIG. 1, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 3), optionally charged scFv linkers (including those shown in FIG. 5) and the heavy chain comprises pI variants (including those shown in FIG. 2).

In some embodiments, the mAb-Fv format includes skew variants, pI variants, and ablation variants. Accordingly, some embodiments include mAb-Fv formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv that binds to GPC3, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv that binds to GPC3 as outlined herein, and a second variable light chain, that together with the second variable heavy domain forms an Fv (ABD) that binds to CD3; and c) a light chain comprising a first variable light domain and a constant light domain.

In some embodiments, the mAb-Fv format includes skew variants, pI variants, ablation variants and FcRn variants. Accordingly, some embodiments include mAb-Fv formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to GPC3, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to GPC3 as outlined herein, and a second variable light chain, that together with the second variable heavy domain of the first monomer forms an Fv (ABD) that binds CD3; and c) a light chain comprising a first variable light domain and a constant light domain.

3. mAb-scFv

Figure 44H:
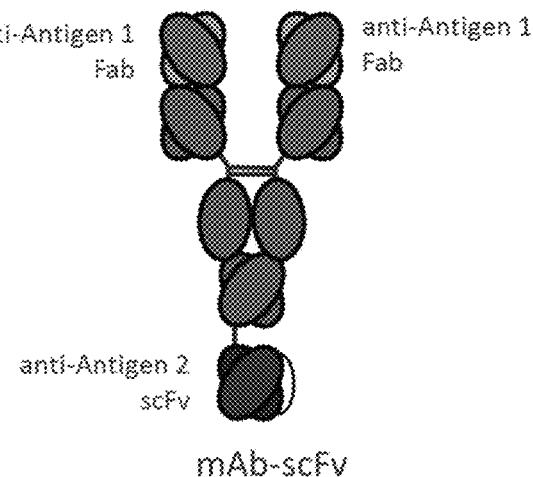

One heterodimeric scaffold that finds particular use in the antibodies described herein is the mAb-scFv format (FIG. 44H). In this embodiment, the format relies on the use of a C-terminal attachment of a scFv to one of the monomers, thus forming a third antigen binding domain, wherein the Fab portions of the two monomers bind GPC3 and the "extra" scFv domain binds CD3. Thus, the first monomer comprises a first heavy chain (comprising a variable heavy domain and a constant domain), with a C-terminally covalently attached scFv comprising a scFv variable light domain, an scFv linker and a scFv variable heavy domain in either orientation (VH1-CH1-hinge-CH2-CH3-[optional linker]-VH2-scFv linker-VL2 or VH1-CH1-hinge-CH2-CH3-[optional linker]-VL2-scFv linker-VH2). This embodiment further utilizes a common light chain comprising a variable light domain and a constant light domain, that associates with the heavy chains to form two identical Fabs that bind GPC3. As for many of the embodiments herein, these constructs include skew variants, pI variants, ablation variants, additional Fc variants, etc. as desired and described herein.

The antibodies described herein provide mAb-scFv formats where the CD binding domain sequences are as shown in FIG. 10A-10F or a variant thereof, and the GPC3 binding domain sequences are as shown in FIGS. 12 and 13 or a variant thereof.

In addition, the Fc domains of the mAb-scFv format comprise skew variants (e.g. a set of amino acid substitutions as shown in FIG. 1, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 3), optionally charged scFv linkers (including those shown in FIG. 5) and the heavy chain comprises pI variants (including those shown in FIG. 2).

In some embodiments, the mAb-scFv format includes skew variants, pI variants, and ablation variants. Accordingly, some embodiments include mAb-scFv formats that comprise: a) a first monomer that comprises the skew variants S364K/E357Q, the ablation variants E233P/L234V/L235A/G236del/S267K, and a variable heavy domain that, with the variable light domain of the common light chain, makes up an Fv that binds to GPC3 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with the variable light domain of the common light chain, makes up an Fv that binds to GPC3 as outlined herein; and c) a common light chain comprising a variable light domain and a constant light domain.

In some embodiments, the mAb-scFv format includes skew variants, pI variants, ablation variants and FcRn variants. Accordingly, some embodiments include mAb-scFv formats that comprise: a) a first monomer that comprises the skew variants S364K/E357Q, the ablation variants E233P/L234V/L235A/G236del/S267K, the FcRn variants M428L/N434S and a variable heavy domain that, with the variable light domain of the common light chain, makes up an Fv that binds to GPC3 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain of the common light chain, makes up an Fv that binds to GPC3 as outlined herein; and c) a common light chain comprising a variable light domain and a constant light domain.

4. 2+1 Fab$_2$-scFv-Fc Format

One heterodimeric scaffold that finds particular use in the antibodies described herein is the "2+1 Fab$_2$-scFv-Fc" format (also referred to in previous related filings as "Central-scFv format") shown in FIG. 15B with an exemplary combination of a CD3 binding domain and two tumor target antigen (GPC3) binding domains. In this embodiment, the format relies on the use of an inserted scFv domain thus forming a third antigen binding domain, wherein the Fab portions of the two monomers bind GPC3 and the "extra" scFv domain binds CD3. The scFv domain is inserted between the Fc domain and the CH1-Fv region of one of the monomers, thus providing a third antigen binding domain. As described, GPC3×CD3 bispecific antibodies having the 2+1 Fab2-scFv-Fc format are potent in inducing redirected T cell cytotoxicity in cellular environments that express low levels of GPC3. Moreover, as shown in the examples, GPC3×CD3 bispecific antibodies having the 2+1 Fab2-scFv-Fc format allow for the "fine tuning" of immune responses as such antibodies exhibit a wide variety of different properties, depending on the GPC3 and/or CD3 binding domains used. For example, such antibodies exhibit differences in selectivity for cells with different GPC3 expression, potencies for GPC3 expressing cells, ability to elicit cytokine release, and sensitivity to soluble GPC3. These GPC3 antibodies find use, for example, in the treatment of GPC3 associated cancers.

In this embodiment, one monomer comprises a first heavy chain comprising a first variable heavy domain, a CH1 domain (and optional hinge) and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using optional domain linkers (VH1-CH1-[optional linker]-VH2-scFv linker-VL2-[optional linker including the hinge]-CH2-CH3, or the opposite orientation for the scFv, VH1-CH1-[optional linker]-VL2-scFv linker-VH2-[optional linker including the hinge]-CH2-CH3). The optional linkers can be any suitable peptide linkers, including, for example, the domain linkers included in FIG. 6. In some embodiments, the optional linker is a hinge or a fragment thereof. The other monomer is a standard Fab side (i.e., VH1-CH1-hinge-CH2-CH3). This embodiment further utilizes a common light chain comprising a variable light domain and a constant light domain, that associates with the heavy chains to form two identical Fabs that bind GPC3. As for many of the embodiments herein, these constructs include skew variants, pI variants, ablation variants, additional Fc variants, etc. as desired and described herein.

In one embodiment, the 2+1 Fab2-scFv-Fc format antibody includes an scFv with the VH and VL of a CD3 binding domain sequence depicted in FIG. 10. In one embodiment, the 2+1 Fab2-scFv-Fc format antibody includes two Fabs having the VH and VL of a GPC3 binding domain as shown in FIGS. 12 and 13.

In exemplary embodiments, the GPC3 binding domain of the 2+1 Fab2-scFv-Fc GPC3×CD3 bispecific antibody includes the VH and VL CD3 binding domain sequences finding particular use in these embodiments include, but are not limited to, H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31 or a variant thereof, as well as those depicted in FIG. 10 and those depicted in FIGS. 14 and 15 of WO2014/145806, hereby incorporated by reference including the Legends.

Any suitable GPC3 ABD can be included in the 2+1 Fab$_2$-scFv-Fc format antibody, included those provided herein. GPC3 ABDs that are of particular use in these embodiments include, but are not limited to, VH and VL domains selected from the group consisting of: [GPC3] H1_L1, [GPC3]H1_L1.1, [GPC3]H1_L1.2, [GPC3] H1_L1.3, [GPC3]H1_L1.4, [GPC3]H1_L1.5, [GPC3] H1_L1.6, [GPC3]H1_L1.7, [GPC3]H1_L1.8, [GPC3] H1_L1.9, [GPC3]H1_L1.10, [GPC3]H1_L1.16, [GPC3] H1_L1.23, [GPC3]H1_L1.29, [GPC3]H1_L1.31, [GPC3] H1_L1.65, [GPC3]H1_L1.66, [GPC3]H1_L1.67, [GPC3] H1_L1.68, [GPC3]H1_L1.70, [GPC3]H1_L1.71, [GPC3] H1_L1.72, [GPC3]H1_L1.73, [GPC3]H1.1_L1, [GPC3] H1.1_L1.1, [GPC3]H1.1_L1.2, [GPC3]H1.1_L1.3, [GPC3] H1.1_L1.4, [GPC3]H1.1_L1.5, [GPC3]H1.1_L1.6, [GPC3] H1.1_L1.7, [GPC3]H1.1_L1.8, [GPC3]H1.1_L1.9, [GPC3] H1.1_L1.10, [GPC3]H1.1_L1.16, [GPC3]H1.1_L1.23, [GPC3]H1.1_L1.29, [GPC3]H1.1_L1.31, [GPC3] H1.1_L1.65, [GPC3]H1.1_L1.66, L1.67, [GPC3] H1.1_L1.68, [GPC3]H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3] H1.2_L1.23, [GPC3]H1.2_L1.29, [GPC3]H1.2_L1.31, [GPC3]H1.2_L1.65, [GPC3]H1.2_L1.66, [GPC3] H1.2_L1.67, [GPC3]H1.2_L1.68, [GPC3]H1.2_L1.70, [GPC3]H1.2_L1.71, [GPC3]H1.2_L1.72, [GPC3] H1.2_L1.73, [GPC3]H1.3_L1, [GPC3]H1.3_L1.1, [GPC3] H1.3_L1.2, [GPC3]H1.3_L1.3, [GPC3]H1.3_L1.4, [GPC3] H1.3_L1.5, [GPC3]H1.3_L1.6, [GPC3]H1.3_L1.7, [GPC3] H1.3_L1.8, [GPC3]H1.3_L1.9, [GPC3]H1.3_L1.10, [GPC3]H1.3_L1.16, [GPC3]H1.3_L1.23, [GPC3] H1.3_L1.29, [GPC3]H1.3_L1.31, [GPC3]H1.3_L1.65, [GPC3]H1.3_L1.66, [GPC3]H1.3_L1.67, [GPC3] H1.3_L1.68, [GPC3]H1.3_L1.70, [GPC3]H1.3_L1.71, [GPC3]H1.3_L1.72, [GPC3]H1.3_L1.73, [GPC3]H1.4_L1, [GPC3]H1.4_L1.1, [GPC3]H1.4_L1.2, [GPC3]H1.4_L1.3, [GPC3]H1.4_L1.4, [GPC3]H1.4_L1.5, [GPC3]H1.4_L1.6, [GPC3]H1.4_L1.7, [GPC3]H1.4_L1.8, [GPC3]H1.4_L1.9, [GPC3]H1.4_L1.10, [GPC3]H1.4_L1.16, [GPC3] H1.4_L1.23, [GPC3]H1.4_L1.29, [GPC3]H1.4_L1.31, [GPC3]H1.4_L1.65, [GPC3]H1.4_L1.66, [GPC3] H1.4_L1.67, [GPC3]H1.4_L1.68, [GPC3]H1.4_L1.70, [GPC3]H1.4_L1.71, [GPC3]H1.4_L1.72 and [GPC3] H1.4_L1.73 or a variant thereof.

In particular embodiments, the VH/VL pairs are selected from the group consisting of [GPC3]H1.1_L1.16 and [GPC3]H1.1_L1.69 or a variant thereof.

In addition, the Fc domains of the 2+1 Fab$_2$-scFv-Fc format comprise skew variants (e.g. a set of amino acid substitutions as shown in FIG. 1, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/ Y349C: T366W/S354C), optionally ablation variants (including those shown in FIG. 3), optionally charged scFv linkers (including those shown in FIG. 5) and the heavy chain comprises pI variants (including those shown in FIG. 2).

In some embodiments, the 2+1 Fab$_2$-scFv-Fc format antibody includes skew variants, pI variants, and ablation variants. Accordingly, some embodiments include 2+1 Fab$_2$-scFv-Fc formats that comprise: a) a first monomer (the Fab-scFv-Fc side) that comprises the skew variants S364K/E357Q, the ablation variants E233P/L234V/L235A/G236del/S267K, and a variable heavy domain that, with the variable light domain of the common light chain, makes up an Fv that binds to GPC3 as outlined herein, and an scFv domain that binds to CD3; b) a second monomer (the Fab-Fc side) that comprises the skew variants L368D/K370S, the pI variants N208D/Q295E/N384D/Q418E/N421D, the ablation variants E233P/L234V/L235A/G236del/S267K, and a variable heavy domain that, with variable light domain of the common light chain, makes up an Fv that binds to GPC3 as outlined herein; and c) a common light chain comprising the variable light domain and a constant light domain, where numbering is according to EU numbering. In some embodiments, the αGPC3 VH/VL pairs are selected from the group consisting of [GPC3]H1.1_L1.16 and [GPC3]H1.1_L1.69.

In some embodiments, the 2+1 Fab$_2$-scFv-Fc format antibody includes skew variants, pI variants, ablation variants and FcRn variants. Accordingly, some embodiments include 2+1 Fab$_2$-scFv-Fc formats that comprise: a) a first monomer (the Fab-scFv-Fc side) that comprises the skew variants S364K/E357Q, the ablation variants E233P/L234V/L235A/G236del/S267K, the FcRn variants M428L/N434S and a variable heavy domain that, with the variable light domain of the common light chain, makes up an Fv that binds to GPC3 as outlined herein, and an scFv domain that binds to CD3; b) a second monomer (the Fab-Fc side) that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with variable light domain of the common light chain, makes up an Fv that binds to GPC3 as outlined herein; and c) a common light chain comprising a variable light domain and a constant light domain, where numbering is according to EU numbering. In some embodiments, the αGPC3 $V_H/V_L$ pairs are selected from the group consisting of [GPC3] H1.1_L1.16 and [GPC3]H1.1_L1.69. CD3 binding domain sequences finding particular use in these embodiments include, but are not limited to, H1.30_L1.47, H1.32_L1.47, H1.89_L1.47, H1.90_L1.47, H1.33_L1.47, H1.31_L1.47, L1.47_H1.30, L1.47_H1.30, L1.47_H1.32, L1.47_H1.89, L1.47_H1.90, L1.47_H1.33, and L1.47_H1.31 or a variant thereof.

FIGS. 8A-8C shows some exemplary Fc domain sequences that are useful with the 2+1 Fab$_2$-scFv-Fc format. The "monomer 1" sequences depicted in FIGS. 8A-8C typically refer to the Fc domain of the "Fab-Fc heavy chain" and the "monomer 2" sequences refer to the Fc domain of the "Fab-scFv-Fc heavy chain." Further, FIG. 9 provides useful CL sequences that can be used with this format.

Exemplary anti-GPC3×anti-CD3 2+1 Fab$_2$-scFv-Fc format antibodies are depicted in FIGS. 18-21.

5. Central-Fv

Figure 44I:
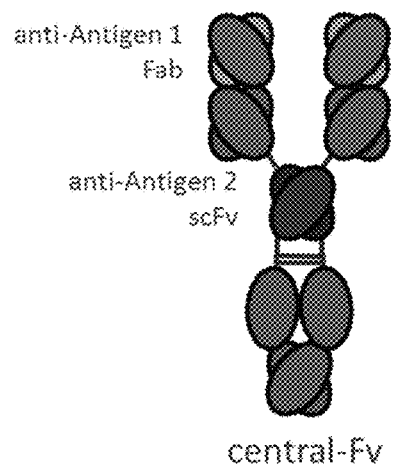

One heterodimeric scaffold that finds particular use in the antibodies described herein is the Central-Fv format (FIG. 44I). In this embodiment, the format relies on the use of an inserted Fv domain (i.e., the central Fv domain) thus forming an "extra" third antigen binding domain, wherein the Fab portions of the two monomers bind a GPC3 and the "extra" central Fv domain binds CD3. The "extra" central Fv domain is inserted between the Fc domain and the CH1-Fv region of the monomers, thus providing a third antigen binding domain (i.e., the "extra" central Fv domain), wherein each monomer contains a component of the "extra" central Fv domain (i.e., one monomer comprises the variable heavy domain and the other a variable light domain of the "extra" central Fv domain).

In this embodiment, one monomer comprises a first heavy chain comprising a first variable heavy domain, a CH1 domain, and Fc domain and an additional variable light domain. The light domain is covalently attached between the C-terminus of the CH1 domain of the heavy constant domain and the N-terminus of the first Fc domain using domain linkers (VH1-CH1-[optional linker]-VL2-hinge-CH2-CH3). The other monomer comprises a first heavy chain comprising a first variable heavy domain, a CH1 domain and Fc domain and an additional variable heavy domain (VH1-CH1-[optional linker]-VH2-hinge-CH2-CH3). The light domain is covalently attached between the C-terminus of the CH1 domain of the heavy constant domain and the N-terminus of the first Fc domain using domain linkers.

This embodiment further utilizes a common light chain comprising a variable light domain and a constant light domain, that associates with the heavy chains to form two identical Fabs that each bind an GPC3. As for many of the embodiments herein, these constructs include skew variants, pI variants, ablation variants, additional Fc variants, etc. as desired and described herein.

The antibodies described herein provide central-Fv formats where the CD3 binding domain sequences are as shown in FIG. 10 or a variant thereof, and the GPC3 binding domain sequences are as shown in FIGS. 12 and 13 or a variant thereof.

6. One-Armed Central-scFv

One heterodimeric scaffold that finds particular use in the antibodies described herein is the one-armed central-scFv format (FIG. 44C). In this embodiment, one monomer comprises just an Fc domain, while the other monomer includes a Fab domain (a first antigen binding domain), a scFv domain (a second antigen binding domain) and an Fc domain, where the scFv domain is inserted between the Fc domain and the Fc domain. In this format, the Fab portion binds one receptor target and the scFv binds another. In this format, either the Fab portion binds a GPC3 and the scFv binds CD3 or vice versa.

In this embodiment, one monomer comprises a first heavy chain comprising a first variable heavy domain, a CH1 domain and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using domain linkers, in either orientation, VH1-CH1-[optional domain linker]-VH2-scFv linker-VL2-[optional domain linker]-CH2-CH3 or VH1-CH1-[optional domain linker]-VL2-scFv linker-VH2-[optional domain linker]-CH2-CH3. The second monomer comprises an Fc domain (CH2-CH3). This embodiment further utilizes a light chain comprising a variable light domain and a constant light domain that associates with the heavy chain to form a Fab.

As for many of the embodiments herein, these constructs include skew variants, pI variants, ablation variants, additional Fc variants, etc. as desired and described herein.

The antibodies described herein provide central-Fv formats where the CD3 binding domain sequences are as shown in FIG. 10 or a variant thereof, and the GPC3 binding domain sequences are as shown in FIGS. 12 and 13 or a variant thereof.

In addition, the Fc domains of the one-armed central-scFv format generally include skew variants (e.g. a set of amino acid substitutions as shown in FIG. 1, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 3), optionally charged scFv linkers (including those shown in FIG. 5) and the heavy chain comprises pI variants (including those shown in FIG. 2).

In some embodiments, the one-armed central-scFv format includes skew variants, pI variants, and ablation variants. Accordingly, some embodiments of the one-armed central-scFv formats comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to GPC3 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K; and c) a light chain comprising a variable light domain and a constant light domain.

In some embodiments, the one-armed central-scFv format includes skew variants, pI variants, ablation variants and FcRn variants. Accordingly, some embodiments of the one-armed central-scFv formats comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to GPC3 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

7. One-Armed scFv-mAb

One heterodimeric scaffold that finds particular use in the antibodies described herein is the one-armed scFv-mAb format (FIG. 44D). In this embodiment, one monomer comprises just an Fc domain, while the other monomer uses a scFv domain attached at the N-terminus of the heavy chain, generally through the use of a linker: VH-scFv linker-VL-[optional domain linker]-CH1-hinge-CH2-CH3 or (in the opposite orientation) VL-scFv linker-VH-[optional domain linker]-CH1-hinge-CH2-CH3. In this format, the Fab portions each bind GPC3 and the scFv binds CD3. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein.

The antibodies described herein provide one-armed scFv-mAb formats where the CD3 binding domain sequences are as shown in FIG. 10 or a variant thereof, and wherein the GPC3 binding domain sequences are as shown in FIGS. 12 and 13 or a variant thereof.

In addition, the Fc domains of the one-armed scFv-mAb format generally include skew variants (e.g. a set of amino acid substitutions as shown in FIG. 1, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 3), optionally charged scFv linkers (including those shown in FIG. 5) and the heavy chain comprises pI variants (including those shown in FIG. 2).

In some embodiments, the one-armed scFv-mAb format includes skew variants, pI variants, and ablation variants. Accordingly, some embodiments of the one-armed scFv-mAb formats comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to GPC3 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K; and c) a light chain comprising a variable light domain and a constant light domain.

In some embodiments, the one-armed scFv-mAb format includes skew variants, pI variants, ablation variants and FcRn variants. Accordingly, some embodiments one-armed scFv-mAb formats comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to GPC3 as outlined herein, and a scFv domain that binds to CD3; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

8. scFv-mAb

One heterodimeric scaffold that finds particular use in the antibodies described herein is the mAb-scFv format (FIG. 44E). In this embodiment, the format relies on the use of a N-terminal attachment of a scFv to one of the monomers, thus forming a third antigen binding domain, wherein the Fab portions of the two monomers bind GPC3 and the "extra" scFv domain binds CD3.

In this embodiment, the first monomer comprises a first heavy chain (comprising a variable heavy domain and a constant domain), with a N-terminally covalently attached scFv comprising a scFv variable light domain, an scFv linker and a scFv variable heavy domain in either orientation ((VH1-scFv linker-VL1-[optional domain linker]-VH2-CH1-hinge-CH2-CH3) or (with the scFv in the opposite orientation) ((VL1-scFv linker-VH1-[optional domain linker]-VH2-CH1-hinge-CH2-CH3)). This embodiment further utilizes a common light chain comprising a variable light domain and a constant light domain that associates with the heavy chains to form two identical Fabs that bind GPC3. As for many of the embodiments herein, these constructs include skew variants, pI variants, ablation variants, additional Fc variants, etc. as desired and described herein.

The antibodies described herein provide scFv-mAb formats where the CD3 binding domain sequences are as shown in FIG. 10 or a variant thereof, and wherein the GPC3 binding domain sequences are as shown in FIGS. 12 and 13 or a variant thereof.

In addition, the Fc domains of the scFv-mAb format generally include skew variants (e.g. a set of amino acid substitutions as shown in FIG. 1, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 3), optionally charged scFv linkers (including those shown in FIG. 5) and the heavy chain comprises pI variants (including those shown in FIG. 2).

In some embodiments, the scFv-mAb format includes skew variants, pI variants, and ablation variants. Accordingly, some embodiments include scFv-mAb formats that comprise: a) a first monomer that comprises the skew variants S364K/E357Q, the ablation variants E233P/L234V/L235A/G236del/S267K, and a variable heavy domain that, with the variable light domain of the common light chain, makes up an Fv that binds to GPC3 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with the variable light domain of the common light chain, makes up an Fv that binds to GPC3 as outlined herein; and c) a common light chain comprising a variable light domain and a constant light domain.

In some embodiments, the scFv-mAb format includes skew variants, pI variants, ablation variants and FcRn variants. Accordingly, some embodiments include scFv-mAb formats that comprise: a) a first monomer that comprises the skew variants S364K/E357Q, the ablation variants E233P/L234V/L235A/G236del/S267K, the FcRn variants M428L/N434S and a variable heavy domain that, with the variable light domain of the common light chain, makes up an Fv that binds to GPC3 as outlined herein, and a scFv domain that binds to CD3; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain of the common light chain, makes up an Fv that binds to GPC3 as outlined herein; and c) a common light chain comprising a variable light domain and a constant light domain.

9. Dual scFv Formats

The antibodies described herein also provide dual scFv formats as are known in the art (FIG. 44B). In this embodiment, the GPC3×CD3 heterodimeric bispecific antibody is made up of two scFv-Fc monomers (both in either (VH-scFv linker-VL-[optional domain linker]-CH2-CH3) format or (VL-scFv linker-VH-[optional domain linker]-CH2-CH3) format, or with one monomer in one orientation and the other in the other orientation.

The antibodies described herein provide dual scFv formats where the CD3 binding domain sequences are as shown in FIG. 10 or a variant thereof, and wherein the GPC3 binding domain sequences are as shown in FIGS. 12 and 13 or a variant thereof.

In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, and a first scFv that binds either CD3 or GPC3; and b) a second monomer that comprises the skew variants L368D/K370S, the pI variants N208D/Q295E/N384D/Q418E/N421D, the ablation variants E233P/L234V/L235A/G236del/S267K, and a second scFv that binds either CD3 or GPC3. In some embodiments, the dual scFv format includes skew variants, pI variants, ablation variants and FcRn variants. In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, the FcRn variants M428L/N434S and a first scFv that binds either CD3 or GPC3; and b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a second scFv that binds either CD3 or GPC3.

10. Non-Heterodimeric Bispecific Antibodies

Figure 44J:
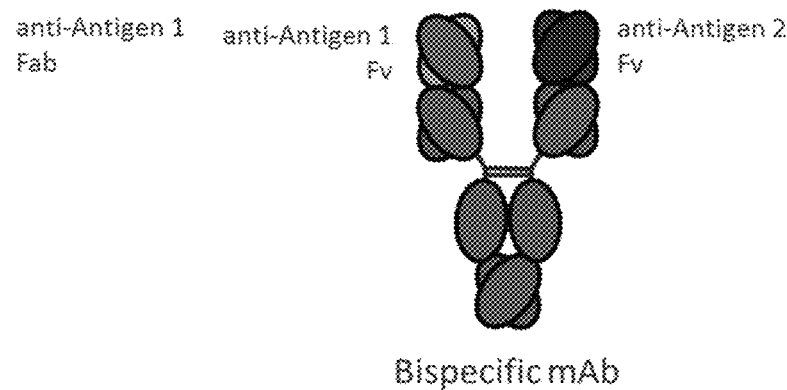

As will be appreciated by those in the art, the anti-GPC3×anti-CD3 antibodies provided herein can also be included in non-heterodimeric bispecific formats (see FIG. 44J). In this format, the anti-GPC3×anti-CD3 includes: 1) a first monomer comprising a VH1-CH1-hinge-CH2-CH3; 2) a second monomer comprising a VH2-CH1-hinge-CH2-CH3; 3) a first light chain comprising a VL1-CL; and 4) a second light chain comprising a VL2-CL. In such embodiments, the VH1 and VL1 form a first antigen binding domain and VH2 and VL2 form a second antigen binding domain. One of the first or second antigen binding domains binds GPC3 and the other antigen binding domain binds CD3.

Any suitable GPC3 binding domain and CD3 binding domain can be included in the anti-GPC3×anti-CD3 antibody in the non-heterodimeric bispecific antibody format, including any of the GPC3 binding domains and CD3 binding domains and related VHs and VLs provided herein or a variant thereof (see, e.g., FIGS. 10, 12 and 13).

11. Trident Format

In some embodiments, the bispecific antibodies described herein are in the "Trident" format as generally described in WO2015/184203, hereby expressly incorporated by reference in its entirety and in particular for the Figures, Legends, definitions and sequences of "Heterodimer-Promoting Domains" or "HPDs", including "K-coil" and "E-coil" sequences. Tridents rely on using two different HPDs that associate to form a heterodimeric structure as a component of the structure. In this embodiment, the Trident format include a "traditional" heavy and light chain (e.g., VH1-CH1-hinge-CH2-CH3 and VL1-CL), a third chain comprising a first "diabody-type binding domain" or "DART®", VH2-(linker)-VL3-HPD1 and a fourth chain comprising a second DART®, VH3-(linker)-(linker)-VL2-HPD2. The VH1 and VL1 form a first ABD, the VH2 and VL2 form a second ABD, and the VH3 and VL3 form a third ABD. In some cases, as is shown in FIG. 1K, the second and third ABDs bind the same antigen, in this instance generally GPC3, e.g., bivalently, with the first ABD binding a CD3 monovalently.

Any suitable GPC3 binding domain and CD3 binding domain can be included in the anti-GPC3×anti-CD3 antibody in the Trident bispecific antibody format, including any of the GPC3 binding domains and CD3 binding domains and related VHs and VLs provided herein or a variant thereof (see, e.g., FIGS. 10, 12 and 13).

12. Monospecific, Monoclonal antibodies

As will be appreciated by those in the art, the novel Fv sequences outlined herein can also be used in both monospecific antibodies (e.g., "traditional monoclonal antibodies") or non-heterodimeric bispecific formats. Accordingly, in some embodiments, the antibodies described herein provide monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H L" designation can be linked to the constant region of a human IgG1 antibody.

In some embodiments, the monospecific antibody is an GPC3 monospecific antibody that has a $V_H/V_L$ pairs selected from the group consisting of: [GPC3]H1_L1, [GPC3]H1_L1.1, [GPC3]H1_L1.2, [GPC3]H1_L1.3, [GPC3]H1_L1.4, [GPC3]H1_L1.5, [GPC3]H1_L1.6, [GPC3]H1_L1.7, [GPC3]H1_L1.8, [GPC3]H1_L1.9, [GPC3]H1_L1.10, [GPC3]H1_L1.16, [GPC3]H1_L1.23, [GPC3]H1_L1.29, [GPC3]H1_L1.31, [GPC3]H1_L1.65, [GPC3]H1_L1.66, [GPC3]H1_L1.67, [GPC3]H1_L1.68, [GPC3]H1_L1.70, [GPC3]H1_L1.71, [GPC3]H1_L1.72, [GPC3]H1_L1.73, [GPC3]H1.1_L1, [GPC3]H1.1_L1.1, [GPC3]H1.1_L1.2, [GPC3]H1.1_L1.3, [GPC3]H1.1_L1.4, [GPC3]H1.1_L1.5, [GPC3]H1.1_L1.6, [GPC3]H1.1_L1.7, [GPC3]H1.1_L1.8, [GPC3]H1.1_L1.9, [GPC3]H1.1_L1.10,

[GPC3]H1.1_L1.16, [GPC3]H1.1_L1.23, [GPC3] H1.1_L1.29, [GPC3]H1.1_L1.31, [GPC3]H1.1_L1.65, [GPC3]H1.1_L1.66, L1.67, [GPC3]H1.1_L1.68, [GPC3] H1.1_L1.70, [GPC3]H1.1_L1.71, [GPC3]H1.1_L1.72, [GPC3]H1.1_L1.73, [GPC3]H1.2_L1, [GPC3]H1.2_L1.1, [GPC3]H1.2_L1.2, [GPC3]H1.2_L1.3, [GPC3]H1.2_L1.4, [GPC3]H1.2_L1.5, [GPC3]H1.2_L1.6, [GPC3]H1.2_L1.7, [GPC3]H1.2_L1.8, [GPC3]H1.2_L1.9, [GPC3]H1.2_L1.10, [GPC3]H1.2_L1.16, [GPC3]H1.2_L1.23, [GPC3] H1.2_L1.29, [GPC3]H1.2_L1.31, [GPC3]H1.2_L1.65, [GPC3]H1.2_L1.66, [GPC3]H1.2_L1.67, [GPC3] H1.2_L1.68, [GPC3]H1.2_L1.70, [GPC3]H1.2_L1.71, [GPC3]H1.2_L1.72, [GPC3]H1.2_L1.73, [GPC3]H1.3_L1, [GPC3]H1.3_L1.1, [GPC3]H1.3_L1.2, [GPC3]H1.3_L1.3, [GPC3]H1.3_L1.4, [GPC3]H1.3_L1.5, [GPC3]H1.3_L1.6, [GPC3]H1.3_L1.7, [GPC3]H1.3_L1.8, [GPC3]H1.3_L1.9, [GPC3]H1.3_L1.10, [GPC3]H1.3_L1.16, [GPC3] H1.3_L1.23, [GPC3]H1.3_L1.29, [GPC3]H1.3_L1.31, [GPC3]H1.3_L1.65, [GPC3]H1.3_L1.66, [GPC3] H1.3_L1.67, [GPC3]H1.3_L1.68, [GPC3]H1.3_L1.70, [GPC3]H1.3_L1.71, [GPC3]H1.3_L1.72, [GPC3] H1.3_L1.73, [GPC3]H1.4_L1, [GPC3]H1.4_L1.1, [GPC3] H1.4_L1.2, [GPC3]H1.4_L1.3, [GPC3]H1.4_L1.4, [GPC3] H1.4_L1.5, [GPC3]H1.4_L1.6, [GPC3]H1.4_L1.7, [GPC3] H1.4_L1.8, [GPC3]H1.4_L1.9, [GPC3]H1.4_L1.10, [GPC3]H1.4_L1.16, [GPC3]H1.4_L1.23, [GPC3] H1.4_L1.29, [GPC3]H1.4_L1.31, [GPC3]H1.4_L1.65, [GPC3]H1.4_L1.66, [GPC3]H1.4_L1.67, [GPC3] H1.4_L1.68, [GPC3]H1.4_L1.70, [GPC3]H1.4_L1.71, [GPC3]H1.4_L1.72 and [GPC3]H1.4_L1.73 or a variant thereof.

In particular embodiments, the VH/VL pairs are selected from the group consisting of [GPC3]H1.1_L1.16 and [GPC3]H1.1_L1.69 or a variant thereof.

H. Particular Embodiments of the Invention

The invention specifically provides 1+1 and 2+1 formats that bind CD3 and GPC3. Certain embodiments include XENP38086 (Xtend analog to XENP34920, meaning they have identical sequences except that the Xtend analog includes 428L/434S on each Fc domain), XENP38087 (Xtend analog to XENP36935, ditto), and XENP38232 (Xtend analog to XENP37625, ditto.)

1. 1+1 Format

In particular 1+1 format embodiments, the αGPC3 ABD is the Fab and has the VH/VL pair [GPC3]H1.1_L1.16 and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

In particular 1+1 format embodiments, the αGPC3 ABD is the Fab and has the VH/VL pair [GPC3]H1.1_L1.69, and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

Particular embodiments that find use in a number of applications include those listed in FIGS. 16 and 17, including, but not limited to, XENP21971, XENP34364, XENP34365, XENP34367, XENP34368, XENP35843, XENP36140, XENP36931, XENP36932 XENP36933, XENP36934, XENP36935, XENP36936, XENP36937, XENP36938, XENP36939, XENP36941 and XENP38087.

2. 2+1 Format

In particular 2+1 format embodiments, the αGPC3 ABD is the Fab and has the VH/VL pair [GPC3]H1.1_L1.16 and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

In particular 2+1 format embodiments, the αGPC3 ABD is the Fab and has the VH/VL pair [GPC3]H1.1_L1.69, and the αCD3 ABD is a scFv selected from the group consisting of anti-CD3_H1.30_L1.47, anti-CD3_H1.32_L1.47, anti-CD3_H1.89_L1.47, anti-CD3_H1.90_L1.47, anti-CD3_H1.33_L1.47, anti-CD3_H1.31_L1.47, anti-CD3_L1.47_H1.30, anti-CD3_L1.47_H1.30, anti-CD3_L1.47_H1.32, anti-CD3_L1.47_H1.89, anti-CD3 L1.47_H1.90, anti-CD3_L1.47_H1.33, and anti-CD3_L1.47_H1.31.

Particular embodiments that find use in a number of applications include those listed in FIGS. 18, 19, 20 and 21, including, but not limited to, XENP33744, XENP33745, XENP27259, XENP33746, XENP34919, XENP34920, XENP34921, XENP34922, XENP34923, XENP35840, XENP35840, XENP37246, XENP37247, XENP38086, XENP33747, XENP35841, XENP37624, XENP37625, XENP37626, XENP38232, XENP37430, XENP37433 and XENP33748.

II. Nucleic Acids of the Invention

The disclosure further provides nucleic acid compositions encoding the anti-GPC3 antibodies provided herein, including, but not limited to, anti-GPC3×anti-CD3 bispecific antibodies and GPC3 monospecific antibodies.

As will be appreciated by those in the art, the nucleic acid compositions will depend on the format and scaffold of the heterodimeric protein. Thus, for example, when the format requires three amino acid sequences, such as for the 1+1 Fab-scFv-Fc format (e.g. a first amino acid monomer comprising an Fc domain and a scFv, a second amino acid monomer comprising a heavy chain and a light chain), three nucleic acid sequences can be incorporated into one or more expression vectors for expression. Similarly, some formats (e.g. dual scFv formats such as disclosed in FIG. 44) only two nucleic acids are needed; again, they can be put into one or two expression vectors.

As is known in the art, the nucleic acids encoding the components of the antibodies described herein can be incorporated into expression vectors as is known in the art, and depending on the host cells used to produce the heterodimeric antibodies described herein. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the antibodies described herein are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer and the optional nucleic acid encoding a light chain, as applicable depending on the format, are each contained within a single expression vector, generally under different or the same promoter controls. In embodiments of particular use in the antibodies described herein, each of these two or three nucleic acids are contained on a different expression vector. As shown herein and in 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results.

The heterodimeric antibodies described herein are made by culturing host cells comprising the expression vector(s) as is well known in the art. Once produced, traditional antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "1+1 Fab-scFv-Fc" and "2+1" heterodimers (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

III. Biological and Biochemical Functionality of the Heterodimeric Bispecific Antibodies Generally the bispecific GPC3×CD3 antibodies described herein are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays.

IV. Treatments

Once made, the compositions of the antibodies described herein find use in a number of applications including cancer such as liver cancer, such that the heterodimeric compositions of the antibodies described herein find use in the treatment of such GPC3 positive cancers.

V. Antibody Compositions for In Vivo Administration

Formulations of the antibodies used in accordance with the antibodies described herein are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions.

VI. Administrative Modalities

The antibodies and chemotherapeutic agents described herein are administered to a subject, in accord with known methods, such as intravenous administration as a bolus or by continuous infusion over a period of time.

VII. Treatment Modalities

In the methods described herein, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MM) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the disclosure includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the disclosure are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies described herein depend on the disease or condition to be treated and may be determined by the persons skilled in the art.

An exemplary, non-limiting range for a therapeutically effective amount of an bispecific antibody used in the antibodies described herein is about 0.1-100 mg/kg.

All cited references are herein expressly incorporated by reference in their entirety.

Whereas particular embodiments of the disclosure have been described above for purposes of illustration, it will be appreciated by those skilled in the art that numerous variations of the details may be made without departing from the invention as described in the appended claims.

EXAMPLES

A. Example 1: Engineering αGPC3×αCD3 Bispecific Antibodies

A number of formats for αGPC3×αCD3 bispecific antibodies (bsAbs) were conceived, illustrative formats for which are outlined below and in FIG. 15.

One such format is the 1+1 Fab-scFv-Fc format which comprises a single-chain Fv ("scFv") covalently attached to a first heterodimeric Fc domain, a heavy chain variable region (VH) covalently attached to a complementary second heterodimeric Fc domain, and a light chain (LC) transfected separately so that a Fab domain is formed with the variable heavy domain.

Another format is the 2+1 Fab2-scFv-Fc format which comprises a VH domain covalently attached to a CH1 domain covalently attached to an scFv covalently attached to a first heterodimeric Fc domain (VH-CH1-scFv-Fc), a VH domain covalently attached to a complementary second heterodimeric Fc domain, and a LC transfected separately so that Fab domains are formed with the VH domains.

DNA encoding chains of the αGPC3×αCD3 bsAbs were generated by standard gene synthesis followed by isothermal cloning (Gibson assembly) or subcloning into a pTT5 expression vector containing fusion partners (e.g. domain linkers as depicted in FIG. 6 and/or backbones as depicted in FIGS. 7-8). DNA was transfected into HEK293E cells for expression. Sequences for illustrative αGPC3×αCD3 bsAbs in the 1+1 Fab-scFv-Fc format and in the 2+1 Fab2-scFv-Fc format are depicted respectively in FIGS. 16-21.

B. Example 2: Engineering GPC3 Binding Domains

2A: Humanization of a Murine GPC3 Binding Domain

A murine clone that binds that C terminal peptide of GPC3 (amino acids 524-563) of the GPC3 protein, located close to the cell membrane was humanized using string content optimization (see, e.g., U.S. Pat. No. 7,657,380, issued Feb. 2, 2010). Sequences for the humanized variant are herein referred to as GPC3-A and are depicted in FIG. 12. Variants reduced degradation (e.g. aspartic acid isomerization and deamidation) liability, modulated GPC3 binding affinity, and/or selectivity for high GPC3 expression cell lines. Sequences for illustrative such variants are depicted in FIG. 13.

2B: Tuning the GPC3 Binding Affinity

After humanization, GPC3 binding arms were engineered with single point mutations in the variable light domain with the aim to create a ladder of GPC3 binding affinity, illustrative sequences for which are depicted in FIG. 13. 73 variable light domain variants were engineered and paired with GPC3-A H1.1 (see Example 3C for description of GPC3-A H1.1 variant). The GPC3-A variants were engineered in the 1+1 Fab-scFv-Fc bsAb format and binding for GPC3 antigen was measured using Octet, a BioLayer Interferometry (BLI)-based method. Experimental steps for Octet generally include the following: Immobilization (capture of ligand to a biosensor); Association (dipping of ligand-coated biosensors into wells containing the analyte); and Dissociation (returning of biosensors to well containing buffer). For ease of clinical development (e.g. by investigating the therapeutics in model animals), it is useful for the binding domains to be cross-reactive for cynomolgus antigen; therefore, binding to both human and cynomolgus GPC3 antigen were investigated. His-tagged human and cynomolgus GPC3 were captured on HIS1K sensors then dipped into multiple concentrations of the bispecific antibodies. The resulting dissociation constant (KD) are depicted in FIG. 23. A broad range of KD values were obtained from high affinity variant H1.1_L1.6 (4 nM), to medium affinity variants H1.1_L1.16 and H1.1_L1.29 (100 nM and 70 nM respectively), to low affinity variant H1.1_L1.31 (400 nM).

Next, binding of the variants to cell surface GPC3 was investigated. Illustrative affinity variants H1.1_L1.29, H1.1_L1.16, and H1.1_L1.31 were engineered in the 1+1 Fab-scFv-Fc format. BsAbs XENP36941 (L1.29, 70 nM GPC3 affinity), XENP35843 (L1.16, 100 nM GPC3 affinity), and XENP36140 (L1.31, 400 nM GPC3 affinity) were incubated with GPC3$^{high}$ HepG2 cells at indicated concentrations for 1 hr at 4° C. Cells were then washed and stained with a secondary antibody (typically anti-human Fc Alexa-Flour647) for 1 hr at 4° C. After 2 more washes, cells were analyzed by flow cytometry. The resulting binding curves portrayed in FIG. 24 show that cell binding correlates with the GPC3 affinity, with XENP36941 (70 nM variable light domain) showing the tightest binding, and the XENP36140 (400 nM variable light domain) showing the weakest.

2C: Engineering to Remove Degradation Liable Residues

The sequences for humanized GPC3-A antibodies were investigated for degradation liable residues. The GPC3-A H1 heavy chain CDR2 included D52/P52a (Kabat numbering) as an aspartic acid isomerization motif. Further, the L1 variable light domain contained an N28/G29 (Kabat numbering) as a deamidation motif. Accordingly, a library was made with mutations at these residues to investigate whether the liability could be removed without impacting on GPC3 binding, binding data for which are depicted in FIG. 25.

D52E mutation in the variable heavy variant H1.1 removed the aspartic acid isomerization liability (relative to H1) while maintaining similar GPC3 binding (D52N resulted in reduced binding, while D52Q and D52S were acceptable). G29T in the variable light variant L1.6 removed the deamidation liability (relative to L1) while maintaining similar GPC3 binding (N28Q, N28Y, N28S, and N28H drastically reduced binding, while G29A and G29K were acceptable). It should be noted that different mutations may be required to remove the deamidation liability from the affinity variants, binding data for illustrative variants as depicted in FIG. 26. G29A mutation was utilized in the L1.69 variant to remove the deamidation liability from the L1.29 variant (N28Y mutation resulted in decreased binding, while G29K was also acceptable); and G29K mutation was utilized in the L1.73 variant to remove the deamidation liability from the L1.31 variant (N28Y and G29A mutations resulted in low or aberrant response). Sequences for the variants described here are depicted in FIG. 13.

C. Example 3: Tuning and Optimizing αGPC3×αCD3 bsAbs

αGPC3×αCD3 bsAbs were engineered with various affinity-tuned GPC3 and CD3 binding domains and with different GPC3 binding valency and produced as generally described in Example 1 to optimize redirected T cell cytotoxicity (RTCC), selectivity, and potential therapeutic index.

RTCC assays were used to investigate the potential of αGPC3×αCD3 bispecific antibodies (bsAbs) to redirect CD3+ effector T cells to destroy GPC3-expressing cell lines. RTCC assays were generally performed using HepG2 cells (a liver hepatocellular carcinoma line) as $GPC3^{high}$ target cells, Huh7 cells (also a liver hepatocellular carcinoma line) as a $GPC3^{med}$ target cells, and/or HEK293 cells as $GPC3^{low}$ target cells (a surrogate for cells outside of the tumor environment). Two methods of redirected T cell cytotoxicity (RTCC) assays were used: flow cytometry based, and lactate dehydrogenase (LDH) based. For flow cytometry based RTCC assays, target cells were incubated with human PBMCs and test articles at indicated effector to target cell ratios at 37° C. After incubation, cells were stained with Aqua Zombie stain for 15 minutes at room temperature. Cells were then washed and stained with antibodies for cell surface markers and analyzed by flow cytometry. Induction of RTCC was determined using Zombie Aqua staining on CSFE+target cells; and activation and degranulation of T cells were determined by CD107a, CD25, and CD69 expression on lymphocytes. For LDH-based RTCC assays, cells and indicated concentrations of test articles would be incubated in a total volume of 200 ul in a flat bottom 96 well plate for 48 or 72 hours at 37° C. Then the cells were lysed and mixed with substrate using the Promega CytoTox-one kit according to its protocol. A Wallac machine was used to read the plate. A V-PLEX proinflammatory panel 1 human kit was used to measure cytokines. It should also be noted that some of the data sets are from the same experiment, as several engineering approaches were simultaneously explored.

Throughout this section, a comparator bsAb XENP31308, which is based on the αGPC3×αCD3 bsAb as disclosed in WO 2016/047722 and sequences for which are depicted in FIG. 22, was also utilized to benchmark the novel bsAbs of the invention. XENP31308 was characterized in RTCC assays as generally described above. Data depicted in FIG. 27 show that at 10:1 effector:target ratio, XENP31308 induced potent RTCC and cytokine secretion on both high and low GPC3 expressing cell lines. In another experiment utilizing 1:1 effector:target ratio data for which are depicted in FIG. 28, XENP31308 induces little RTCC in the presence of low GPC3 expressing cell line HEK293 but still potently induces cytokine secretion. As the $GPC3^{low}$ cell line is a surrogate for healthy tissues, maintaining very little to no killing and cytokine release in the presence of a low GPC3 expressing cell line is important as it may translate to less toxicity and cytokine storm in a clinical setting. Strong killing of a $GPC3^{low}$ cell line would indicate likelihood of on-target off-tissue killing in vivo, which could cause undesirable toxicity.

3A: Investigating the Effect of GPC3 Binding Domain Binding Different GPC3 Epitopes GPC3 is membrane bound and consists of an alpha subunit and a beta subunit. The alpha subunit (residues 25-358) may be cleaved and released as soluble GPC3, the while the beta subunit remains attached to the cellular membrane. As described in Example 2A, GPC3 binding domain GPC3-A binds C-terminal residues 524-563 of GPC3 which is part of the beta subunit. Additional GPC3 binding domains have been described to bind the N-terminal residues 359-524 of the beta subunit or the alpha subunit. To investigate the effect of binding to different GPC3 epitopes, αGPC3×αCD3 bsAbs in the 1+1 format with CD3 High or 2+1 format with CD3 High-Int #1 scFv were engineered with different GPC3 binding domains binding different GPC3 epitopes. An RTCC assay was performed using the bsAbs and HepG2 cells (10:1 effector:target ratio). The data in FIG. 29 (depicting activity of the bsAbs as indicated by induction of IFNγ release) show that each of the additional epitopes were less potent at inducing T cell activity than GPC3-A. While some of the difference may be due to differences in binding affinity (between clones) or avidity (between formats), it is likely that the GPC3 epitope contributes to the reduced potency.

3B: Investigating the Effect of GPC3 Binding Avidity

It was hypothesized that bsAbs in the 2+1 Fab$_2$-scFv-Fc format having bivalent binding for GPC3 may be useful in achieving higher potency with a lower affinity binding domain due to the improved avidity from two binding domains. The avidity benefit of this format may confer selectivity to cell lines with higher target expression, reducing the potential for on-target off-tissue (e.g. healthy tissues expressing low levels of GPC3) effects in vivo. Additionally, high levels of soluble GPC3 may be present in vivo, potentially acting as an antigen sink for GPC3-targeting drugs. Lower GPC3 binding affinity coupled with bivalent GPC3 binding may help overcome the sink by preferably binding cells with high antigen density over soluble antigen. Accordingly, the cell binding of αGPC3×αCD3 bispecific antibodies in the 1+1 Fab-scFv-Fc format, the 2+1 Fab2-scFv-Fc format, and the traditional monospecific bivalent format were investigated. The GPC3-A variable light domains L1.16 (having a GPC3 binding affinity of 100 nM) and L1.31 (having a GPC3 binding affinity of 400 nM) were engineered into the 1+1 Fab-scFv-Fc format, the 2+1 Fab2-scFv-Fc (VL/VH), and bivalent monospecific IgG1 format. Test articles were incubated with $GPC3^{high}$ HepG2 cells at indicated concentrations, washed, stained with a secondary antibody, washed again, and analyzed by flow cytometry as described above. As seen in FIG. 30, the avidity conferred by the 2+1 Fab$_2$-scFv-Fc (VL/VH) format improves binding compared to the 1+1 Fab-scFv-Fc format, reaching a level similar to that of the standard bivalent IgG. Additionally, the lower affinity L1.31 clone more drastically shows this improvement over the 1+1 Fab-scFv-Fc indicating that the lower binding affinity creates more of a dependence on avidity and binding valency.

3C: Investigating the Effect of Variant CD3 Binding Domains on RTCC

To investigate the effect of CD3 binding affinity, αGPC3× αCD3 bsAbs were produced in the 1+1 Fab-scFv-Fc and the 2+1 Fab$_2$-scFv-Fc formats with CD3 High scFv, CD3 High-Int #1 scFv, CD3 High-Int #2 scFv, and CD3 Intermediate scFvs and GPC3-A variants having 100 nM or 400 nM binding affinity for GPC3 and investigated in a flow-based RTCC performed as described above using a 10:1 E:T ratio on GPC3$^{high}$ HepG2 target cells with a 48 hour incubation time. The data plotted in FIGS. 31A and 32A (respectively for bsAbs in the 1+1 format and in the 2+1 format) showed that affinity-engineered αGPC3×αCD3 bsAbs demonstrated a range of potencies to GPC3$^{high}$ HepG2 cells, from high (XENP33744 having a 5 nM CD3 arm and 2+1 format, with an EC50 value of 62.63 pg/ml) to low (XENP27259 having a 30 nM CD3 arm in a 1+1 format, with an EC50 value of 19920 pg/ml). The bispecific antibodies also induced release of IFNγ (as depicted in FIGS. 31B and 32B) and T cell activation (as indicated by expression of activation markers such as CD69 and 107a; data not shown) in a manner correlated to their potency. Notably, de-tuning the CD3 binding affinity from CD3 High to CD3 High-Int #1 in the 1+1 Fab-scFv-Fc format provided a much greater potency reduction in induction of cytokine release in comparison to in the 2+1 Fab$_2$-scFv-Fc format. However, in the 2+1 Fab$_2$-scFv-Fc format, de-tuning the CD3 binding affinity with CD3 High-Int #2 and CD3 Intermediate still resulted in potency reduction in induction of cytokine release.

3D: Investigating the Effect of Affinity Detuned GPC3 Binding Domains on RTCC

In another experiment, the effect of engineering affinity reductions in the GPC3 binding domains of a set of αGPC3× αCD3 bsAbs as described in Example 2 on the ability to redirect CD3+ effector T cells was investigated. An LDH-based RTCC assay was performed as described above, using GPC3$^{med}$ Huh7 as target cells, mixed with indicated concentrations of test articles and PBMC effector cells at a 10:1 E:T ratio, for a 48 hour incubation time. FIG. 33 shows that XENP37625 (having a variable light domain L1.69, 70 nM GPC3 affinity), XENP37624 (having a variable light domain L1.16, 100 nM GPC3 affinity), and XENP37626 (having a variable light domain L1.73, 400 nM GPC3 affinity) each demonstrated reduced potency of killing and IFNγ secretion roughly in accordance with their respective affinities.

3E: Investigating the Ability of αGPC3×αCD3 bsAbs to Induce RTCC on Cell Lines with Different GPC3 Expression Levels On-target, off-tumor toxicity and cytokine release syndrome can result in severe adverse effects in patients; therefore, it is important to tune the bsAbs of the invention to avoid killing and induction of cytokine release in the presence of healthy tissues which express low levels of GPC3.

Accordingly, based on the various observations described above, additional αGPC3×αCD3 bsAbs were engineered, produced, and investigated to identify bsAbs with maximal therapeutic potential with minimal potential for toxicity. Towards this, the effects of modulating GPC3 binding affinity, GPC3 binding valency, and CD3 binding affinity on selectivity of the bispecific antibodies for cell lines with high and low expression were investigated.

HepG2 (GPC3$^{high}$) and HEK293 (GPC3$^{low}$) cells were each incubated with human PBMCs (1:1 effector to target cell ratio) and indicated concentrations of the test articles for 72 hours at 37° C. Data depicting induction of RTCC and cytokine secretion are depicted in FIGS. 34 and 35. Consistent with the above, the bispecific antibodies demonstrated a range of potencies in inducing RTCC and cytokine release in the presence of GPC3$^{high}$ HepG2 cell. Notably, in the presence of GPC3$^{low}$ HEK293 cells, each of the bispecific antibodies demonstrated little to no induction of RTCC and cytokine release.

3F: Further Characterization of αGPC3×αCD3 bsAbs Using 2D RTCC on Incucyte

The novel αGPC3×αCD3 bsAbs and the comparator molecule XENP31308 were investigated utilizing a different system (2D RTCC on Incucyte). Indicated concentrations of indicated test articles were incubated with HepG2 or Huh7 cells and T cells at 10:1 or 1:1 effector:target ratio. Data depicting RTCC are depicted in FIGS. 36-38. At a 10:1 effector:target (HepG2) ratio, bsAbs XENP34920, XENP37430, XENP37625, and XENP37624 demonstrated similar potency (less than EC50 of 100 ng/ml) as comparator XENP31308; other bsAbs XENP35843, XENP36935, XENP37433, and XENP37626 were much less potent but were able to achieve efficacious killing at higher concentrations, and XENP36939 did not demonstrate any killing. Notably on lower density Huh7 and at lower effector:target ratio, several of the bsAbs of the invention (e.g. XENP34920, XENP36935, and XENP37625) demonstrate much greater difference in EC50 in comparison to the XENP31308 comparator indicating potential for enhanced therapeutic index. Additionally, when GPC3high HepG2 and GPC3med Huh7 target cells were treated with test articles at a concentration of 10 pg/ml at a 10:1 E:T ratio and observed over different time points ranging from 24 to 144 hours, similar results were seen. As depicted in FIGS. 39-40, the affinity detuned αGPC3×αCD3 bsAbs including XENP34920, XENP37430, XENP36935, XENP37624, and XENP37625 were effective at inhibiting tumor growth over time in both HepG2 and Huh7 target cells, and their efficacy was very similar to that of XENP31308.

3G: Further Characterization of αGPC3×αCD3 bsAbs Using a 3D Spheroid RTCC Model

An additional RTCC system was used to further investigate the affinity detuned αGPC3×αCD3 bsAbs. In this system, target tumor cells grow in a 3D spheroid format, which is physiologically more similar to an in vivo tumor compared to cells growing in a monolayer on a flat surface. In this experiment, 1,000 HepG2 cells (which have a doubling time of 24 hours) were seeded and given 72-96 hours to grow before adding 40,000 PBMCs (resulting in an E:T ratio of approximately 3:1) along with the indicated bsAb at a concentration of 10 ug/ml. The intensity of each signal (tumor or immune cell) was integrated over each well across different time points, and this data is depicted in FIGS. 41-42. FIG. 43 additionally shows photographic images taken of the tumor cells and PBMCs. With PBS treatment only, the tumor spheroids and the PBMCs clustered around them remain unchanged over time, whereas when treated with the αGPC3×αCD3 bsAbs PBMCs proliferate dramatically (as depicted quantitatively in FIG. 42), and the tumor cells are destroyed (as depicted quantitatively in FIG. 41). All αGPC3×αCD3 bsAbs except XENP36939 show 100% efficacy after 144 hours.

The 3D spheroid model also produced an unexpected result in test articles with the lower affinity High-Int #2 CD3 binding domain. Generally, for 2+1 bsAbs in a 2D model, the CD3 affinity difference between the High-Int #1 binding domain and the High-Int #2 binding domain results in roughly a 10-fold potency difference, such as what can be seen in FIG. 38. However, in this 3D model, XENP34920 and XENP37624, both having with the same 100 nM GPC3 binding domain but XENP34920 having the High-Int #1 CD3 binding domain and XENP37624 having the High-Int #2 binding domain, showed potency curves that were very similar. Depicted in FIG. 41, the unexpected result of this 3D model, which should more closely mimic an in vivo model, provides useful insight on the potency of a weaker CD3 binder in this context.

D. Example 4: Identifying αGPC3×αCD3 bsAbs with Optimal Selectivity and Therapeutic Index Based on the above in vitro experiments, several bsAbs were selected for further analysis in vivo. These antibodies were further engineered with Xtend Fc (M428L/N434S) to enhance serum half-life, illustrative sequences which are depicted in FIGS. 17, 19, and 20 as XENP38086 (Xtend analog to XENP34920), XENP38087 (Xtend analog to XENP36935), and XENP38232 (Xtend analog to XENP37625).

1. 4A: In Vivo Investigation for Toxicity in Cynomolgus

Studies in cynomolgus are planned to investigate whether the improvement in vitro (i.e. selectivity for $GPC^{high}$ over $GPC^{low}$ target cells, and reduced cytokine release in the presence of $GPC^{low}$ cells) translates to improved safety in an in vivo setting. In a Phase 1 dose escalation study, animals (n=1) are intravenously dosed with 1×, 3×, 10×, 30×, and 60× dose of XENP38086, XENP38087, or XENP38232. Blood is drawn to determine IL-6 concentrations as an indicator of cytokine release syndrome. Animals may be sacrificed to investigate additional signs of toxicity.

SEQUENCE LISTING (446 sequences)

SEQ ID NO: 1 - protein, 15 aa, Artificial Sequence
  Description of Artificial Sequence: Synthetic peptide
  Positive Charged scFv Linker Gly-Ser 15
GGGGSGGGGSGGGGS

SEQ ID NO: 2 - protein, 5 aa, Artificial Sequence
  Description of Artificial Sequence: Synthetic peptide
  See specification as filed for detailed description of substitutions and preferred embodiments
GGGGS

SEQ ID NO: 3 - protein, 5 aa, Artificial Sequence
  Description of Artificial Sequence: Synthetic peptide
  See specification as filed for detailed description of substitutions and preferred embodiments
GSGGS

SEQ ID NO: 4 - protein, 4 aa, Artificial Sequence
  Description of Artificial Sequence: Synthetic peptide
  See specification as filed for detailed description of substitutions and preferred embodiments
GGGS

SEQ ID NO: 5 - protein, 5 aa, Artificial Sequence
  Description of Artificial Sequence: Synthetic peptide
  Domain linker
GGGGS

SEQ ID NO: 6 - protein, 20 aa, Artificial Sequence
  Description of Artificial Sequence: Synthetic peptide
  scFv Linker
GKPGSGKPGSGKPGSGKPGS

SEQ ID NO: 7 - protein, 18 aa, Artificial Sequence
  Description of Artificial Sequence: Synthetic peptide
  Positive Charged scFv Linker Whitlow linker
GSTSGSGKPGSGEGSTKG

SEQ ID NO: 8 - protein, 14 aa, Artificial Sequence
  Description of Artificial Sequence: Synthetic peptide
  Positive Charged scFv Linker 6paxA_1 (+A)
IRPRAIGGSKPRVA

SEQ ID NO: 9 - protein, 15 aa, Artificial Sequence
  Description of Artificial Sequence: Synthetic peptide
  Positive Charged scFv Linker +B
GKGGSGKGGSGKGGS

SEQ ID NO: 10 - protein, 15 aa, Artificial Sequence
  Description of Artificial Sequence: Synthetic peptide
  Positive Charged scFv Linker +C
GGKGSGGKGSGGKGS

SEQ ID NO: 11 - protein, 15 aa, Artificial Sequence
  Description of Artificial Sequence: Synthetic peptide
  Positive Charged scFv Linker +D
GGGKSGGGKSGGGKS

SEQ ID NO: 12 - protein, 15 aa, Artificial Sequence
  Description of Artificial Sequence: Synthetic peptide
  Positive Charged scFv Linker +E
GKGKSGKGKSGKGKS

SEQ ID NO: 13 - protein, 15 aa, Artificial Sequence
  Description of Artificial Sequence: Synthetic peptide
  Positive Charged scFv Linker +F
GGGKSGGKGSGKGGS

SEQ ID NO: 14 - protein, 15 aa, Artificial Sequence
  Description of Artificial Sequence: Synthetic peptide
  Positive Charged scFv Linker +G
GKPGSGKPGSGKPGS

SEQ ID NO: 15 - protein, 20 aa, Artificial Sequence
  Description of Artificial Sequence: Synthetic peptide
  Positive Charged scFv Linker +H
GKPGSGKPGSGKPGSGKPGS

SEQ ID NO: 16 - protein, 20 aa, Artificial Sequence
  Description of Artificial Sequence: Synthetic peptide
  Positive Charged scFv Linker +I
GKGKSGKGKSGKGKSGKGKS

SEQ ID NO: 17 - protein, 20 aa, Artificial Sequence
  Description of Artificial Sequence: Synthetic peptide
  Negative Charged scFv Linker Gly-Ser 20
GGGGSGGGGSGGGGSGGGGS

SEQ ID NO: 18 - protein, 14 aa, Artificial Sequence
  Description of Artificial Sequence: Synthetic peptide
  Negative Charged scFv Linker 3hsc_2 (-A)
STAGDTHLGGEDFD

SEQ ID NO: 19 - protein, 15 aa, Artificial Sequence
  Description of Artificial Sequence: Synthetic peptide
  Negative Charged scFv Linker -B
GEGGSGEGGSGEGGS

SEQ ID NO: 20 - protein, 15 aa, Artificial Sequence
  Description of Artificial Sequence: Synthetic peptide
  Negative Charged scFv Linker -C
GGEGSGGEGSGGEGS

SEQ ID NO: 21 - protein, 15 aa, Artificial Sequence
  Description of Artificial Sequence: Synthetic peptide
  Negative Charged scFv Linker -D
GGGESGGGESGGGES

SEQ ID NO: 22 - protein, 15 aa, Artificial Sequence
  Description of Artificial Sequence: Synthetic peptide
  Negative Charged scFv Linker -E
GEGESGEGESGEGES

SEQ ID NO: 23 - protein, 15 aa, Artificial Sequence
  Description of Artificial Sequence: Synthetic peptide
  Negative Charged scFv Linker -F
GGGESGGEGSGEGGS

SEQ ID NO: 24 - protein, 20 aa, Artificial Sequence
  Description of Artificial Sequence: Synthetic peptide
  Negative Charged scFv Linker -G
GEGESGEGESGEGESGEGES

SEQ ID NO: 25 - protein, 15 aa, Artificial Sequence
  Description of Artificial Sequence: Synthetic peptide
  scFv Linker
GGGGSGGGGSGGGGS

SEQ ID NO: 26 - protein, 20 aa, Artificial Sequence
  Description of Artificial Sequence: Synthetic peptide
  scFv Linker
GGGGSGGGGSGGGGSGGGGS

SEQ ID NO: 27 - protein, 18 aa, Artificial Sequence
  Description of Artificial Sequence: Synthetic peptide
  scFv Linker
GSTSGSGKPGSGEGSTKG

SEQ ID NO: 28 - protein, 19 aa, Artificial Sequence
  Description of Artificial Sequence: Synthetic peptide
  scFv Linker
PRGASKSGSASQTGSAPGS

SEQ ID NO: 29 - protein, 19 aa, Artificial Sequence
  Description of Artificial Sequence: Synthetic peptide
  scFv Linker
GTAAAGAGAAGGAAAGAAG

SEQ ID NO: 30 - protein, 19 aa, Artificial Sequence
  Description of Artificial Sequence: Synthetic peptide
  scFv Linker
GTSGSSGSGSGGSGSGGGG

SEQ ID NO: 31 - protein, 10 aa, Artificial Sequence
  Description of Artificial Sequence: Synthetic peptide
  Domain linker
GGGGSGGGGS

SEQ ID NO: 32 - protein, 15 aa, Artificial Sequence
  Description of Artificial Sequence: Synthetic peptide
  Domain linker
GGGGSGGGGSGGGGS

SEQ ID NO: 33 - protein, 20 aa, Artificial Sequence
  Description of Artificial Sequence: Synthetic peptide
  Domain linker
GGGGSGGGGSGGGGSGGGGS

SEQ ID NO: 34 - protein, 25 aa, Artificial Sequence
  Description of Artificial Sequence: Synthetic peptide
  Domain linker
GGGGSGGGGSGGGGSGGGGSGGGGS

SEQ ID NO: 35 - protein, 30 aa, Artificial Sequence
  Description of Artificial Sequence: Synthetic polypeptide
  Domain linker
GGGGSGGGGSGGGGSGGGGSGGGGSGGGGS

SEQ ID NO: 36 - protein, 35 aa, Artificial Sequence
  Description of Artificial Sequence: Synthetic polypeptide
  Domain linker
GGGGSGGGGSGGGGSGGGGSGGGGSGGGGSGGGGS

SEQ ID NO: 37 - protein, 5 aa, Artificial Sequence
  Description of Artificial Sequence: Synthetic peptide
  Domain linker
GGGGA

SEQ ID NO: 38 - protein, 10 aa, Artificial Sequence
  Description of Artificial Sequence: Synthetic peptide
  Domain linker
GGGGAGGGGA

SEQ ID NO: 39 - protein, 15 aa, Artificial Sequence
  Description of Artificial Sequence: Synthetic peptide
  Domain linker
GGGGAGGGGAGGGGA

SEQ ID NO: 40 - protein, 20 aa, Artificial Sequence
  Description of Artificial Sequence: Synthetic peptide
  Domain linker
GGGGAGGGGAGGGGAGGGGA

SEQ ID NO: 41 - protein, 25 aa, Artificial Sequence
  Description of Artificial Sequence: Synthetic peptide
  Domain linker
GGGGAGGGGAGGGGAGGGGAGGGGA

SEQ ID NO: 42 - protein, 30 aa, Artificial Sequence
  Description of Artificial Sequence: Synthetic polypeptide
  Domain linker
GGGGAGGGGAGGGGAGGGGAGGGGAGGGGA

SEQ ID NO: 43 - protein, 35 aa, Artificial Sequence
  Description of Artificial Sequence: Synthetic polypeptide
  Domain linker
GGGGAGGGGAGGGGAGGGGAGGGGAGGGGAGGGGA

SEQ ID NO: 44 - protein, 30 aa, Artificial Sequence
  Description of Artificial Sequence: Synthetic polypeptide
  Domain linker 30AA-linker
DPALVHQRPAPPGGGGSGGGGSGGGGSGGG

SEQ ID NO: 45 - protein, 5 aa, Artificial Sequence
  Description of Artificial Sequence: Synthetic peptide
  Domain linker
GKPGS

SEQ ID NO: 46 - protein, 25 aa, Artificial Sequence
  Description of Artificial Sequence: Synthetic peptide
  Domain linker
GKPGSGKPGSGKPGSGKPGSGKPGS

SEQ ID NO: 47 - protein, 30 aa, Artificial Sequence
  Description of Artificial Sequence: Synthetic polypeptide
  Domain linker
GKPGSGKPGSGKPGSGKPGSGKPGSGKPGS

SEQ ID NO: 48 - protein, 5 aa, Artificial Sequence
  Description of Artificial Sequence: Synthetic peptide
  Domain linker
GGGES

SEQ ID NO: 49 - protein, 9 aa, Artificial Sequence
  Description of Artificial Sequence: Synthetic peptide
  Domain linker "half hinge"
KTHTCPPCP

SEQ ID NO: 50 - protein, 15 aa, Artificial Sequence
  Description of Artificial Sequence: Synthetic peptide
  Domain linker "full hinge C220S variant"
EPKSSDKTHTCPPCP

SEQ ID NO: 51 - protein, 19 aa, Artificial Sequence
  Description of Artificial Sequence: Synthetic peptide
  Domain linker "flex half hinge"
GGGGSGGGGSKTHTCPPCP

SEQ ID NO: 52 - protein, 19 aa, Artificial Sequence
  Description of Artificial Sequence: Synthetic peptide
  Domain linker "charged half hinge1"
GKPGSGKPGSKTHTCPPCP

SEQ ID NO: 53 - protein, 14 aa, Artificial Sequence
  Description of Artificial Sequence: Synthetic peptide
  Domain linker "charged half hinge2"
GKPGSKTHTCPPCP

SEQ ID NO: 54 - protein, 329 aa, Artificial Sequence
  Description of Artificial Sequence: Synthetic polypeptide
  1 + 1 Fab-scFv-Fc Backbone 1 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 55 - protein, 231 aa, Artificial Sequence
  Description of Artificial Sequence: Synthetic polypeptide
  1 + 1 Fab-scFv-Fc Backbone 1 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 329 aa, Artificial Sequence; identical to SEQ ID NO: 54
  Description of Artificial Sequence: Synthetic polypeptide
  1 + 1 Fab-scFv-Fc Backbone 2 Fab-Fc Side

SEQ ID NO: 57 - protein, 231 aa, Artificial Sequence
  Description of Artificial Sequence: Synthetic polypeptide
  1 + 1 Fab-scFv-Fc Backbone 2 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 329 aa, Artificial Sequence
  Description of Artificial Sequence: Synthetic polypeptide
  1 + 1 Fab-scFv-Fc Backbone 3 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 59 - protein, 231 aa, Artificial Sequence; identical to SEQ ID NO: 57
  Description of Artificial Sequence: Synthetic polypeptide
  1 + 1 Fab-scFv-Fc Backbone 3 scFv-Fc Side

SEQ ID NO: 60 - protein, 329 aa, Artificial Sequence
  Description of Artificial Sequence: Synthetic polypeptide
  1 + 1 Fab-scFv-Fc Backbone 4 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 61 - protein, 231 aa, Artificial Sequence
  Description of Artificial Sequence: Synthetic polypeptide
  1 + 1 Fab-scFv-Fc Backbone 4 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 62 - protein, 329 aa, Artificial Sequence
  Description of Artificial Sequence: Synthetic polypeptide
  1 + 1 Fab-scFv-Fc Backbone 5 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 63 - protein, 231 aa, Artificial Sequence
  Description of Artificial Sequence: Synthetic polypeptide
  1 + 1 Fab-scFv-Fc Backbone 5 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 329 aa, Artificial Sequence
  Description of Artificial Sequence: Synthetic polypeptide
  1 + 1 Fab-scFv-Fc Backbone 6 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 65 - protein, 231 aa, Artificial Sequence
  Description of Artificial Sequence: Synthetic polypeptide
  1 + 1 Fab-scFv-Fc Backbone 6 scFv-Fc Side
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 329 aa, Artificial Sequence
  Description of Artificial Sequence: Synthetic polypeptide
  1 + 1 Fab-scFv-Fc Backbone 7 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 67 - protein, 231 aa, Artificial Sequence
  Description of Artificial Sequence: Synthetic polypeptide
  1 + 1 Fab-scFv-Fc Backbone 7 scFv-Fc Side
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 327 aa, Artificial Sequence
  Description of Artificial Sequence: Synthetic polypeptide
  1 + 1 Fab-scFv-Fc Backbone 8 Fab-Fc Side
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 69 - protein, 229 aa, Artificial Sequence
  Description of Artificial Sequence: Synthetic polypeptide
  1 + 1 Fab-scFv-Fc Backbone 8 scFv-Fc Side
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 70 - protein, 326 aa, Artificial Sequence
  Description of Artificial Sequence: Synthetic polypeptide
  1 + 1 Fab-scFv-Fc Backbone 9 Fab-Fc Side
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 71 - protein, 228 aa, Artificial Sequence
  Description of Artificial Sequence: Synthetic polypeptide
  1 + 1 Fab-scFv-Fc Backbone 9 scFv-Fc Side
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 72 - protein, 326 aa, Artificial Sequence
  Description of Artificial Sequence: Synthetic polypeptide
  1 + 1 Fab-scFv-Fc Backbone 10 Fab-Fc Side
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 73 - protein, 228 aa, Artificial Sequence
  Description of Artificial Sequence: Synthetic polypeptide
  1 + 1 Fab-scFv-Fc Backbone 10 scFv-Fc Side
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 74 - protein, 329 aa, Artificial Sequence
  Description of Artificial Sequence: Synthetic polypeptide
  1 + 1 Fab-scFv-Fc Backbone 11 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 75 - protein, 231 aa, Artificial Sequence
  Description of Artificial Sequence: Synthetic polypeptide
  1 + 1 Fab-scFv-Fc Backbone 11 scFv-Fc Side
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 76 - protein, 329 aa, Artificial Sequence
  Description of Artificial Sequence: Synthetic polypeptide
  1 + 1 Fab-scFv-Fc Backbone 12 Fab-Fc Side
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCDVAGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 231 aa, Artificial Sequence
  Description of Artificial Sequence: Synthetic polypeptide
  1 + 1 Fab-scFv-Fc Backbone 12 scFv-Fc Side
ERKSSDKTHTCPPRPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 329 aa, Artificial Sequence; identical to SEQ ID NO: 54
  Description of Artificial Sequence: Synthetic polypeptide
  2 + 1 Fab2-scFv-Fc Backbone 1 Fab-Fc Side

SEQ ID NO: 79 - protein, 216 aa, Artificial Sequence
  Description of Artificial Sequence: Synthetic polypeptide
  2 + 1 Fab2-scFv-Fc Backbone 1 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 329 aa, Artificial Sequence; identical to SEQ ID NO: 54
  Description of Artificial Sequence: Synthetic polypeptide
  2 + 1 Fab2-scFv-Fc Backbone 2 Fab-Fc Side

SEQ ID NO: 81 - protein, 216 aa, Artificial Sequence
  Description of Artificial Sequence: Synthetic polypeptide
  2 + 1 Fab2-scFv-Fc Backbone 2 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 329 aa, Artificial Sequence; identical to SEQ ID NO: 58
  Description of Artificial Sequence: Synthetic polypeptide
  2 + 1 Fab2-scFv-Fc Backbone 3 Fab-Fc Side

SEQ ID NO: 83 - protein, 216 aa, Artificial Sequence; identical to SEQ ID NO: 81
  Description of Artificial Sequence: Synthetic polypeptide
  2 + 1 Fab2-scFv-Fc Backbone 3 Fab-scFv-Fc Side

SEQ ID NO: 84 - protein, 329 aa, Artificial Sequence; identical to SEQ ID NO: 60
  Description of Artificial Sequence: Synthetic polypeptide
  2 + 1 Fab2-scFv-Fc Backbone 4 Fab-Fc Side

SEQ ID NO: 85 - protein, 216 aa, Artificial Sequence
  Description of Artificial Sequence: Synthetic polypeptide
  2 + 1 Fab2-scFv-Fc Backbone 4 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 86 - protein, 329 aa, Artificial Sequence; identical to SEQ ID NO: 62
  Description of Artificial Sequence: Synthetic polypeptide
  2 + 1 Fab2-scFv-Fc Backbone 5 Fab-Fc Side

SEQ ID NO: 87 - protein, 216 aa, Artificial Sequence
  Description of Artificial Sequence: Synthetic polypeptide
  2 + 1 Fab2-scFv-Fc Backbone 5 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 329 aa, Artificial Sequence; identical to SEQ ID NO: 64
  Description of Artificial Sequence: Synthetic polypeptide
  2 + 1 Fab2-scFv-Fc Backbone 6 Fab-Fc Side

SEQ ID NO: 89 - protein, 216 aa, Artificial Sequence
  Description of Artificial Sequence: Synthetic polypeptide
  2 + 1 Fab2-scFv-Fc Backbone 6 Fab-scFv-Fc Side
APPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 329 aa, Artificial Sequence; identical to SEQ ID NO: 66
  Description of Artificial Sequence: Synthetic polypeptide
  2 + 1 Fab2-scFv-Fc Backbone 7 Fab-Fc Side

SEQ ID NO: 91 - protein, 216 aa, Artificial Sequence
  Description of Artificial Sequence: Synthetic polypeptide
  2 + 1 Fab2-scFv-Fc Backbone 7 Fab-scFv-Fc Side
APPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 329 aa, Artificial Sequence; identical to SEQ ID NO: 74
  Description of Artificial Sequence: Synthetic polypeptide
  2 + 1 Fab2-scFv-Fc Backbone 8 Fab-Fc Side

SEQ ID NO: 93 - protein, 216 aa, Artificial Sequence
  Description of Artificial Sequence: Synthetic polypeptide
  2 + 1 Fab2-scFv-Fc Backbone 8 Fab-scFv-Fc Side
APPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 94 - protein, 329 aa, Artificial Sequence; identical to SEQ ID NO: 76
  Description of Artificial Sequence: Synthetic polypeptide
  2 + 1 Fab2-scFv-Fc Backbone 9 Fab-Fc Side

SEQ ID NO: 95 - protein, 216 aa, Artificial Sequence
  Description of Artificial Sequence: Synthetic polypeptide
  2 + 1 Fab2-scFv-Fc Backbone 9 Fab-scFv-Fc Side
APPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 107 aa, Artificial Sequence [sequence omitted]

SEQ ID NO: 97 - protein, 106 aa, Artificial Sequence
  Description of Artificial Sequence: Synthetic polypeptide
  Constant Light Domain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 98 - protein, 254 aa, Artificial Sequence
  Description of Artificial Sequence: Synthetic polypeptide
  CD3 High - [anti-CD3]_H1.30_L1.47_scFv scFv (VHVL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 99 - protein, 254 aa, Artificial Sequence
  Description of Artificial Sequence: Synthetic polypeptide
  CD3 High - [anti-CD3]_H1.30_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 100 - protein, 125 aa, Artificial Sequence
  Description of Artificial Sequence: Synthetic polypeptide
  CD3 High - [anti-CD3]_H1.30_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 101 - protein, 5 aa, Artificial Sequence
  Description of Artificial Sequence: Synthetic peptide
  CD3 High - [anti-CD3]_H1.30_L1.47_scFv vhCDR1
TYAMN

SEQ ID NO: 102 - protein, 19 aa, Artificial Sequence
  Description of Artificial Sequence: Synthetic peptide
  CD3 High - [anti-CD3]_H1.30_L1.47_scFv vhCDR2
RIRSKYNNYATYYADSVKG

SEQ ID NO: 103 - protein, 14 aa, Artificial Sequence
  Description of Artificial Sequence: Synthetic peptide
  CD3 High - [anti-CD3]_H1.30_L1.47_scFv vhCDR3
HGNFGDSYVSWFAY

SEQ ID NO: 104 - protein, 109 aa, Artificial Sequence
  Description of Artificial Sequence: Synthetic polypeptide
  CD3 High - [anti-CD3]_H1.30_L1.47_scFv Variable Light (vl) Domain
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 105 - protein, 14 aa, Artificial Sequence
  Description of Artificial Sequence: Synthetic peptide
  CD3 High - [anti-CD3]_H1.30_L1.47_scFv vlCDR1
GSSTGAVTTSNYAN

SEQ ID NO: 106 - protein, 7 aa, Artificial Sequence
  Description of Artificial Sequence: Synthetic peptide
  CD3 High - [anti-CD3]_H1.30_L1.47_scFv vlCDR2
GTNKRAP

SEQ ID NO: 107 - protein, 9 aa, Artificial Sequence
  Description of Artificial Sequence: Synthetic peptide
  CD3 High - [anti-CD3]_H1.30_L1.47_scFv vlCDR3
ALWYSNHWV

SEQ ID NO: 108 - protein, 20 aa, Artificial Sequence
  Description of Artificial Sequence: Synthetic peptide
  CD3 High - [anti-CD3]_H1.30_L1.47_scFv Linker
GKPGSGKPGSGKPGSGKPGS

SEQ ID NO: 109 - protein, 254 aa, Artificial Sequence
  Description of Artificial Sequence: Synthetic polypeptide
  CD3 High-Int #1 - [anti-CD3]_H1.32_L1.47_scFv scFv (VHVL)
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 110 - protein, 254 aa, Artificial Sequence
  Description of Artificial Sequence: Synthetic polypeptide
  CD3 High-Int #1 - [anti-CD3]_H1.32_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 111 - protein, 125 aa, Artificial Sequence
  Description of Artificial Sequence: Synthetic polypeptide
  CD3 High-Int #1 - [anti-CD3]_H1.32_L1.47_scFv Variable Heavy (vh) Domain
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 112 - protein, 5 aa, Artificial Sequence
  Description of Artificial Sequence: Synthetic peptide
  CD3 High-Int #1 - [anti-CD3]_H1.32_L1.47_scFv vhCDR1
TYAMN

SEQ ID NO: 113 - protein, 19 aa, Artificial Sequence
  Description of Artificial Sequence: Synthetic peptide
  CD3 High-Int #1 - [anti-CD3]_H1.32_L1.47_scFv vhCDR2
RIRSKANNYATYYADSVKG

SEQ ID NO: 114 - protein, 14 aa, Artificial Sequence
  Description of Artificial Sequence: Synthetic peptide
  CD3 High-Int #1 - [anti-CD3]_H1.32_L1.47_scFv vhCDR3
HGNFGDSYVSWFAY

SEQ ID NO: 115 - protein, 109 aa, Artificial Sequence; identical to SEQ ID NO: 104
  Description of Artificial Sequence: Synthetic polypeptide
  CD3 High-Int #1 - [anti-CD3]_H1.32_L1.47_scFv Variable Light (vl) Domain

SEQ ID NO: 116 - protein, 14 aa, Artificial Sequence
  Description of Artificial Sequence: Synthetic peptide
  CD3 High-Int #1 - [anti-CD3]_H1.32_L1.47_scFv vlCDR1
GSSTGAVTTSNYAN

SEQ ID NO: 117 - protein, 7 aa, Artificial Sequence
  Description of Artificial Sequence: Synthetic peptide
  CD3 High-Int #1 - [anti-CD3]_H1.32_L1.47_scFv vlCDR2
GTNKRAP

SEQ ID NO: 118 - protein, 9 aa, Artificial Sequence
  Description of Artificial Sequence: Synthetic peptide
  CD3 High-Int #1 - [anti-CD3]_H1.32_L1.47_scFv vlCDR3
ALWYSNHWV

SEQ ID NO: 119 - protein, 20 aa, Artificial Sequence
  Description of Artificial Sequence: Synthetic peptide
  CD3 High-Int #1 - [anti-CD3]_H1.32_L1.47_scFv Linker
GKPGSGKPGSGKPGSGKPGS

SEQ ID NO: 120 - protein, 254 aa, Artificial Sequence
  Description of Artificial Sequence: Synthetic polypeptide
  CD3 High-Int #2 - [anti-CD3]_H1.89_L1.47_scFv scFv (VHVL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 121 - protein, 254 aa, Artificial Sequence
  Description of Artificial Sequence: Synthetic polypeptide
  CD3 High-Int #2 - [anti-CD3]_H1.89_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 122 - protein, 125 aa, Artificial Sequence
  Description of Artificial Sequence: Synthetic polypeptide
  CD3 High-Int #2 - [anti-CD3]_H1.89_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 123 - protein, 5 aa, Artificial Sequence
  Description of Artificial Sequence: Synthetic peptide
  CD3 High-Int #2 - [anti-CD3]_H1.89_L1.47_scFv vhCDR1
TYAMN

SEQ ID NO: 124 - protein, 19 aa, Artificial Sequence
  Description of Artificial Sequence: Synthetic peptide
  CD3 High-Int #2 - [anti-CD3]_H1.89_L1.47_scFv vhCDR2
RIRSKYNNYATYYADSVKG

SEQ ID NO: 125 - protein, 14 aa, Artificial Sequence
  Description of Artificial Sequence: Synthetic peptide
  CD3 High-Int #2 - [anti-CD3]_H1.89_L1.47_scFv vhCDR3
HGNFGDEYVSWFAY

SEQ ID NO: 126 - protein, 109 aa, Artificial Sequence; identical to SEQ ID NO: 104
  Description of Artificial Sequence: Synthetic polypeptide
  CD3 High-Int #2 - [anti-CD3]_H1.89_L1.47_scFv Variable Light (vl) Domain

SEQ ID NO: 127 - protein, 14 aa, Artificial Sequence
  Description of Artificial Sequence: Synthetic peptide
  CD3 High-Int #2 - [anti-CD3]_H1.89_L1.47_scFv vlCDR1
GSSTGAVTTSNYAN

SEQ ID NO: 128 - protein, 7 aa, Artificial Sequence
  Description of Artificial Sequence: Synthetic peptide
  CD3 High-Int #2 - [anti-CD3]_H1.89_L1.47_scFv vlCDR2
GTNKRAP

SEQ ID NO: 129 - protein, 9 aa, Artificial Sequence
  Description of Artificial Sequence: Synthetic peptide
  CD3 High-Int #2 - [anti-CD3]_H1.89_L1.47_scFv vlCDR3
ALWYSNHWV

SEQ ID NO: 130 - protein, 20 aa, Artificial Sequence
  Description of Artificial Sequence: Synthetic peptide
  CD3 High-Int #2 - [anti-CD3]_H1.89_L1.47_scFv Linker
GKPGSGKPGSGKPGSGKPGS

SEQ ID NO: 131 - protein, 254 aa, Artificial Sequence
  Description of Artificial Sequence: Synthetic polypeptide
  CD3 High-Int #3 - [anti-CD3]_H1.90_L1.47_scFv scFv (VHVL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 132 - protein, 254 aa, Artificial Sequence
  Description of Artificial Sequence: Synthetic polypeptide
  CD3 High-Int #3 - [anti-CD3]_H1.90_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 133 - protein, 125 aa, Artificial Sequence
  Description of Artificial Sequence: Synthetic polypeptide
  CD3 High-Int #3 - [anti-CD3]_H1.90_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 134 - protein, 5 aa, Artificial Sequence
  Description of Artificial Sequence: Synthetic peptide
  CD3 High-Int #3 - [anti-CD3]_H1.90_L1.47_scFv vhCDR1
TYAMN

SEQ ID NO: 135 - protein, 19 aa, Artificial Sequence
  Description of Artificial Sequence: Synthetic peptide
  CD3 High-Int #3 - [anti-CD3]_H1.90_L1.47_scFv vhCDR2
RIRSKYNNYATYYADSVKG

SEQ ID NO: 136 - protein, 14 aa, Artificial Sequence
  Description of Artificial Sequence: Synthetic peptide
  CD3 High-Int #3 - [anti-CD3]_H1.90_L1.47_scFv vhCDR3
HGNFGDPYVSWFAY

SEQ ID NO: 137 - protein, 109 aa, Artificial Sequence; identical to SEQ ID NO: 104
  Description of Artificial Sequence: Synthetic polypeptide
  CD3 High-Int #3 - [anti-CD3]_H1.90_L1.47_scFv Variable Light (vl) Domain

SEQ ID NO: 138 - protein, 14 aa, Artificial Sequence
  Description of Artificial Sequence: Synthetic peptide
  CD3 High-Int #3 - [anti-CD3]_H1.90_L1.47_scFv vlCDR1
GSSTGAVTTSNYAN

SEQ ID NO: 139 - protein, 7 aa, Artificial Sequence
  Description of Artificial Sequence: Synthetic peptide
  CD3 High-Int #3 - [anti-CD3]_H1.90_L1.47_scFv vlCDR2
GTNKRAP

SEQ ID NO: 140 - protein, 9 aa, Artificial Sequence
  Description of Artificial Sequence: Synthetic peptide
  CD3 High-Int #3 - [anti-CD3]_H1.90_L1.47_scFv vlCDR3
ALWYSNHWV

SEQ ID NO: 141 - protein, 20 aa, Artificial Sequence
  Description of Artificial Sequence: Synthetic peptide
  CD3 High-Int #3 - [anti-CD3]_H1.90_L1.47_scFv Linker
GKPGSGKPGSGKPGSGKPGS

SEQ ID NO: 142 - protein, 254 aa, Artificial Sequence
  Description of Artificial Sequence: Synthetic polypeptide
  CD3-Intermediate - [anti-CD3]_H1.33_L1.47_scFv scFv (VHVL)
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 143 - protein, 254 aa, Artificial Sequence
  Description of Artificial Sequence: Synthetic polypeptide
  CD3-Intermediate - [anti-CD3]_H1.33_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 144 - protein, 125 aa, Artificial Sequence
  Description of Artificial Sequence: Synthetic polypeptide
  CD3-Intermediate - [anti-CD3]_H1.33_L1.47_scFv Variable Heavy (vh) Domain
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 145 - protein, 5 aa, Artificial Sequence
  Description of Artificial Sequence: Synthetic peptide
  CD3-Intermediate - [anti-CD3]_H1.33_L1.47_scFv vhCDR1
TYAMN

SEQ ID NO: 146 - protein, 19 aa, Artificial Sequence
  Description of Artificial Sequence: Synthetic peptide
  CD3-Intermediate - [anti-CD3]_H1.33_L1.47_scFv vhCDR2
RIRSKYNNYATYYADSVKG

SEQ ID NO: 147 - protein, 14 aa, Artificial Sequence
  Description of Artificial Sequence: Synthetic peptide
  CD3-Intermediate - [anti-CD3]_H1.33_L1.47_scFv vhCDR3
HGNFGDSYVSWFDY

SEQ ID NO: 148 - protein, 109 aa, Artificial Sequence; identical to SEQ ID NO: 104
  Description of Artificial Sequence: Synthetic polypeptide
  CD3-Intermediate - [anti-CD3]_H1.33_L1.47_scFv Variable Light (vl) Domain

SEQ ID NO: 149 - protein, 14 aa, Artificial Sequence
  Description of Artificial Sequence: Synthetic peptide
  CD3-Intermediate - [anti-CD3]_H1.33_L1.47_scFv vlCDR1
GSSTGAVTTSNYAN

SEQ ID NO: 150 - protein, 7 aa, Artificial Sequence
  Description of Artificial Sequence: Synthetic peptide
  CD3-Intermediate - [anti-CD3]_H1.33_L1.47_scFv vlCDR2
GTNKRAP

SEQ ID NO: 151 - protein, 9 aa, Artificial Sequence
  Description of Artificial Sequence: Synthetic peptide
  CD3-Intermediate - [anti-CD3]_H1.33_L1.47_scFv vlCDR3
ALWYSNHWV

SEQ ID NO: 152 - protein, 20 aa, Artificial Sequence
  Description of Artificial Sequence: Synthetic peptide
  CD3-Intermediate - [anti-CD3]_H1.33_L1.47_scFv Linker
GKPGSGKPGSGKPGSGKPGS

SEQ ID NO: 153 - protein, 254 aa, Artificial Sequence
  Description of Artificial Sequence: Synthetic polypeptide
  CD3 Low - [anti-CD3]_H1.31_L1.47_scFv scFv (VHVL)
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 154 - protein, 254 aa, Artificial Sequence
  Description of Artificial Sequence: Synthetic polypeptide
  CD3 Low - [anti-CD3]_H1.31_L1.47_scFv scFv (VLVH)
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 155 - protein, 125 aa, Artificial Sequence
  Description of Artificial Sequence: Synthetic polypeptide
  CD3 Low - [anti-CD3]_H1.31_L1.47_scFv Variable Heavy (vh) Domain
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 156 - protein, 5 aa, Artificial Sequence
  Description of Artificial Sequence: Synthetic peptide
  CD3 Low - [anti-CD3]_H1.31_L1.47_scFv vhCDR1
TYAMS

SEQ ID NO: 157 - protein, 19 aa, Artificial Sequence
  Description of Artificial Sequence: Synthetic peptide
  CD3 Low - [anti-CD3]_H1.31_L1.47_scFv vhCDR2
RIRSKYNNYATYYADSVKG

SEQ ID NO: 158 - protein, 14 aa, Artificial Sequence
  Description of Artificial Sequence: Synthetic peptide
  CD3 Low - [anti-CD3]_H1.31_L1.47_scFv vhCDR3
HGNFGDSYVSWFAY

SEQ ID NO: 159 - protein, 109 aa, Artificial Sequence; identical to SEQ ID NO: 104
  Description of Artificial Sequence: Synthetic polypeptide
  CD3 Low - [anti-CD3]_H1.31_L1.47_scFv Variable Light (vl) Domain

SEQ ID NO: 160 - protein, 14 aa, Artificial Sequence
  Description of Artificial Sequence: Synthetic peptide
  CD3 Low - [anti-CD3]_H1.31_L1.47_scFv vlCDR1
GSSTGAVTTSNYAN

SEQ ID NO: 161 - protein, 7 aa, Artificial Sequence
  Description of Artificial Sequence: Synthetic peptide
  CD3 Low - [anti-CD3]_H1.31_L1.47_scFv vlCDR2
GTNKRAP

SEQ ID NO: 162 - protein, 9 aa, Artificial Sequence
  Description of Artificial Sequence: Synthetic peptide
  CD3 Low - [anti-CD3]_H1.31_L1.47_scFv vlCDR3
ALWYSNHWV

SEQ ID NO: 163 - protein, 20 aa, Artificial Sequence
  Description of Artificial Sequence: Synthetic peptide
  CD3 Low - [anti-CD3]_H1.31_L1.47_scFv Linker
GKPGSGKPGSGKPGSGKPGS

SEQ ID NO: 164 - protein, 580 aa, Homo sapiens
  Human GPC3 sequence  sp|P51654
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 165 - protein, 334 aa, Homo sapiens
  Human GPC3 sequence, alpha subunit sp|P51654|25-358
QPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYR

SEQ ID NO: 166 - protein, 196 aa, Homo sapiens
  Human GPC3 sequence, beta subunit sp|P51654|359-554
SAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHN

SEQ ID NO: 167 - protein, 580 aa, Macaca fascicularis
  Macaca fascicularis GPC3 sequence  tr|A0A2K5VK50
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSVPKGRVLDKNLDEEGFESGDCGDDEDECIGGSGDGMMKVKNQLRFLAELAYDLDVDDVPGNNQQATPKDNEISTFHNLGNVHSPLKLLTSMAISVVCFFFLVH

SEQ ID NO: 168 - protein, 334 aa, Macaca fascicularis; identical to SEQ ID NO: 165
  Macaca fascicularis GPC3 sequence, alpha subunit (predicted) tr|A0A2K5VK50|25-358

SEQ ID NO: 169 - protein, 196 aa, Macaca fascicularis
  Macaca fascicularis GPC3 sequence, beta subunit (predicted) tr|A0A2K5VK50|359-554
SAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSVPKGRVLDKNLDEEGFESGDCGDDEDECIGGSGDGMMKVKNQLRFLAELAYDLDVDDVPGNNQQATPKDNEISTFHN

SEQ ID NO: 170 - protein, 579 aa, Mus musculus
  Mouse GPC3 sequence  sp|Q8CFZ4
MAGTVRTACLLVAMLLGLGCLGQAQPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQMMNPGLPESVLDINECLRGARRDLKVFGSFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNGGKLTTTIGKLCAHSQQRQYRSAYYPEDLFIDKKILKVAHVEHEETLSSRRRELIQKLKSFINFYSALPGYICSHSPVAENDTLCWNGQELVERYSQKAARNGMKNQFNLHELKMKGPEPVVSQIIDKLKHINQLLRTMSVPKGKVLDKSLDEEGLESGDCGDDEDECIGSSGDGMVKVKNQLRFLAELAYDLDVDDAPGNKQHGNQKDNEITTSHSVGNMPSPLKILISVAIYVACFFFLVH

SEQ ID NO: 171 - protein, 333 aa, Mus musculus
  Mouse GPC3 sequence, alpha subunit sp|Q8CFZ4|25-357
QPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQMMNPGLPESVLDINECLRGARRDLKVFGSFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNGGKLTTTIGKLCAHSQQRQYR

SEQ ID NO: 172 - protein, 196 aa, Mus musculus
  Mouse GPC3 sequence, beta subunit sp|Q8CFZ4|358-553
SAYYPEDLFIDKKILKVAHVEHEETLSSRRRELIQKLKSFINFYSALPGYICSHSPVAENDTLCWNGQELVERYSQKAARNGMKNQFNLHELKMKGPEPVVSQIIDKLKHINQLLRTMSVPKGKVLDKSLDEEGLESGDCGDDEDECIGSSGDGMVKVKNQLRFLAELAYDLDVDDAPGNKQHGNQKDNEITTSHS

SEQ ID NO: 173 - protein, 115 aa, Artificial Sequence
  Description of Artificial Sequence: Synthetic polypeptide
  GPC3-A[GPC3]_H1 Variable heavy (vh) domain
QVQLVQSGAEVKKPGASVKVSCKASGYTFTDYEMHWVRQAPGQGLEWMGALDPKTGDTAYSQKFQGRVTMTADKSISTAYMELSRLRSDDTAVYYCTRFYSYTYWGQGTLVTVSS

SEQ ID NO: 174 - protein, 5 aa, Artificial Sequence
  Description of Artificial Sequence: Synthetic peptide
  GPC3-A[GPC3]_H1 vhCDR1
DYEMH

SEQ ID NO: 175 - protein, 17 aa, Artificial Sequence
  Description of Artificial Sequence: Synthetic peptide
  GPC3-A[GPC3]_H1 vhCDR2
ALDPKTGDTAYSQKFQG

SEQ ID NO: 176 - protein, 6 aa, Artificial Sequence
  Description of Artificial Sequence: Synthetic peptide
  GPC3-A[GPC3]_H1 vhCDR3
FYSYTY

SEQ ID NO: 177 - protein, 112 aa, Artificial Sequence
  Description of Artificial Sequence: Synthetic polypeptide
  GPC3-A[GPC3]_L1 Variable light (vl) domain
DVVMTQSPLSLPVTLGQPASISCRSSQSLVHSNGNTYLHWYQQRPGQSPRLLIYKVSNRFSGVPDRFSGSGSGTDFTLKISRVEAEDVGVYFCSQNTHVPPTFGSGTKLEIK

SEQ ID NO: 178 - protein, 16 aa, Artificial Sequence
  Description of Artificial Sequence: Synthetic peptide
  GPC3-A[GPC3]_L1 vlCDR1
RSSQSLVHSNGNTYLH

SEQ ID NO: 179 - protein, 7 aa, Artificial Sequence
  Description of Artificial Sequence: Synthetic peptide
  GPC3-A[GPC3]_L1 vlCDR2
KVSNRFS

SEQ ID NO: 180 - protein, 9 aa, Artificial Sequence
  Description of Artificial Sequence: Synthetic peptide
  GPC3-A[GPC3]_L1 vlCDR3
SQNTHVPPT

SEQ ID NO: 181 - protein, 115 aa, Artificial Sequence
  Description of Artificial Sequence: Synthetic polypeptide
  GPC3-A[GPC3]_H1.1 Variable heavy (vh) domain
QVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSS

SEQ ID NO: 182 - protein, 5 aa, Artificial Sequence
  Description of Artificial Sequence: Synthetic peptide
  GPC3-A[GPC3]_H1.1 vhCDR1
DYEMH

SEQ ID NO: 183 - protein, 17 aa, Artificial Sequence
  Description of Artificial Sequence: Synthetic peptide
  GPC3-A[GPC3]_H1.1 vhCDR2
ALEPKTGDTAYSQKFQG

SEQ ID NO: 184 - protein, 6 aa, Artificial Sequence
  Description of Artificial Sequence: Synthetic peptide
  GPC3-A[GPC3]_H1.1 vhCDR3
FYSYTY

SEQ ID NO: 185 - protein, 115 aa, Artificial Sequence
  Description of Artificial Sequence: Synthetic polypeptide
  GPC3-A[GPC3]_H1.2 Variable heavy (vh) domain
QVQLVQSGAEVKKPGASVKVSCKASGYTFTDYEMHWVRQAPGQGLEWMGALNPKTGDTAYSQKFQGRVTMTADKSISTAYMELSRLRSDDTAVYYCTRFYSYTYWGQGTLVTVSS

SEQ ID NO: 186 - protein, 5 aa, Artificial Sequence
  Description of Artificial Sequence: Synthetic peptide
  GPC3-A[GPC3]_H1.2 vhCDR1
DYEMH

SEQ ID NO: 187 - protein, 17 aa, Artificial Sequence
  Description of Artificial Sequence: Synthetic peptide
  GPC3-A[GPC3]_H1.2 vhCDR2
ALNPKTGDTAYSQKFQG

SEQ ID NO: 188 - protein, 6 aa, Artificial Sequence
  Description of Artificial Sequence: Synthetic peptide
  GPC3-A[GPC3]_H1.2 vhCDR3
FYSYTY

SEQ ID NO: 189 - protein, 115 aa, Artificial Sequence
  Description of Artificial Sequence: Synthetic polypeptide
  GPC3-A[GPC3]_H1.3 Variable heavy (vh) domain
QVQLVQSGAEVKKPGASVKVSCKASGYTFTDYEMHWVRQAPGQGLEWMGALQPKTGDTAYSQKFQGRVTMTADKSISTAYMELSRLRSDDTAVYYCTRFYSYTYWGQGTLVTVSS

SEQ ID NO: 190 - protein, 5 aa, Artificial Sequence
  Description of Artificial Sequence: Synthetic peptide
  GPC3-A[GPC3]_H1.3 vhCDR1
DYEMH

SEQ ID NO: 191 - protein, 17 aa, Artificial Sequence
  Description of Artificial Sequence: Synthetic peptide
  GPC3-A[GPC3]_H1.3 vhCDR2
ALQPKTGDTAYSQKFQG

SEQ ID NO: 192 - protein, 6 aa, Artificial Sequence
  Description of Artificial Sequence: Synthetic peptide
  GPC3-A[GPC3]_H1.3 vhCDR3
FYSYTY

SEQ ID NO: 193 - protein, 115 aa, Artificial Sequence
  Description of Artificial Sequence: Synthetic polypeptide
  GPC3-A[GPC3]_H1.4 Variable heavy (vh) domain
QVQLVQSGAEVKKPGASVKVSCKASGYTFTDYEMHWVRQAPGQGLEWMGALSPKTGDTAYSQKFQGRVTMTADKSISTAYMELSRLRSDDTAVYYCTRFYSYTYWGQGTLVTVSS

SEQ ID NO: 194 - protein, 5 aa, Artificial Sequence
  Description of Artificial Sequence: Synthetic peptide
  GPC3-A[GPC3]_H1.4 vhCDR1
DYEMH

SEQ ID NO: 195 - protein, 17 aa, Artificial Sequence
  Description of Artificial Sequence: Synthetic peptide
  GPC3-A[GPC3]_H1.4 vhCDR2
ALSPKTGDTAYSQKFQG

SEQ ID NO: 196 - protein, 6 aa, Artificial Sequence
  Description of Artificial Sequence: Synthetic peptide
  GPC3-A[GPC3]_H1.4 vhCDR3
FYSYTY

SEQ ID NO: 197 - protein, 115 aa, Artificial Sequence; identical to SEQ ID NO: 173
  Description of Artificial Sequence: Synthetic polypeptide
  GPC3-A[GPC3]_ L1.1 Variable light (vl) domain

SEQ ID NO: 198 - protein, 5 aa, Artificial Sequence
  Description of Artificial Sequence: Synthetic peptide
  GPC3-A[GPC3]_ L1.1 vlCDR1
DYEMH

SEQ ID NO: 199 - protein, 17 aa, Artificial Sequence
  Description of Artificial Sequence: Synthetic peptide
  GPC3-A[GPC3]_ L1.1 vlCDR2
ALDPKTGDTAYSQKFQG

SEQ ID NO: 200 - protein, 6 aa, Artificial Sequence
  Description of Artificial Sequence: Synthetic peptide
  GPC3-A[GPC3]_ L1.1 vlCDR3
FYSYTY

SEQ ID NO: 201 - protein, 115 aa, Artificial Sequence; identical to SEQ ID NO: 173
  Description of Artificial Sequence: Synthetic polypeptide
  GPC3-A[GPC3]_ L1.2 Variable light (vl) domain

SEQ ID NO: 202 - protein, 5 aa, Artificial Sequence
  Description of Artificial Sequence: Synthetic peptide
  GPC3-A[GPC3]_ L1.2 vlCDR1
DYEMH

SEQ ID NO: 203 - protein, 17 aa, Artificial Sequence
  Description of Artificial Sequence: Synthetic peptide
  GPC3-A[GPC3]_ L1.2 vlCDR2
ALDPKTGDTAYSQKFQG

SEQ ID NO: 204 - protein, 6 aa, Artificial Sequence
  Description of Artificial Sequence: Synthetic peptide
  GPC3-A[GPC3]_ L1.2 vlCDR3
FYSYTY

SEQ ID NO: 205 - protein, 115 aa, Artificial Sequence; identical to SEQ ID NO: 173
  Description of Artificial Sequence: Synthetic polypeptide
  GPC3-A[GPC3]_ L1.3 Variable light (vl) domain

SEQ ID NO: 206 - protein, 5 aa, Artificial Sequence
  Description of Artificial Sequence: Synthetic peptide
  GPC3-A[GPC3]_ L1.3 vlCDR1
DYEMH

SEQ ID NO: 207 - protein, 17 aa, Artificial Sequence
  Description of Artificial Sequence: Synthetic peptide
  GPC3-A[GPC3]_ L1.3 vlCDR2
ALDPKTGDTAYSQKFQG

SEQ ID NO: 208 - protein, 6 aa, Artificial Sequence
  Description of Artificial Sequence: Synthetic peptide
  GPC3-A[GPC3]_ L1.3 vlCDR3
FYSYTY

SEQ ID NO: 209 - protein, 115 aa, Artificial Sequence; identical to SEQ ID NO: 173
  Description of Artificial Sequence: Synthetic polypeptide
  GPC3-A[GPC3]_ L1.4 Variable light (vl) domain

SEQ ID NO: 210 - protein, 5 aa, Artificial Sequence
  Description of Artificial Sequence: Synthetic peptide
  GPC3-A[GPC3]_ L1.4 vlCDR1
DYEMH

SEQ ID NO: 211 - protein, 17 aa, Artificial Sequence
  Description of Artificial Sequence: Synthetic peptide
  GPC3-A[GPC3]_ L1.4 vlCDR2
ALDPKTGDTAYSQKFQG

SEQ ID NO: 212 - protein, 6 aa, Artificial Sequence
  Description of Artificial Sequence: Synthetic peptide
  GPC3-A[GPC3]_ L1.4 vlCDR3
FYSYTY

SEQ ID NO: 213 - protein, 115 aa, Artificial Sequence; identical to SEQ ID NO: 173
  Description of Artificial Sequence: Synthetic polypeptide
  GPC3-A[GPC3]_ L1.5 Variable light (vl) domain

SEQ ID NO: 214 - protein, 5 aa, Artificial Sequence
  Description of Artificial Sequence: Synthetic peptide
  GPC3-A[GPC3]_ L1.5 vlCDR1
DYEMH

SEQ ID NO: 215 - protein, 17 aa, Artificial Sequence
  Description of Artificial Sequence: Synthetic peptide
  GPC3-A[GPC3]_ L1.5 vlCDR2
ALDPKTGDTAYSQKFQG

SEQ ID NO: 216 - protein, 6 aa, Artificial Sequence
  Description of Artificial Sequence: Synthetic peptide
  GPC3-A[GPC3]_ L1.5 vlCDR3
FYSYTY

SEQ ID NO: 217 - protein, 112 aa, Artificial Sequence
  Description of Artificial Sequence: Synthetic polypeptide
  GPC3-A[GPC3]_ L1.6 Variable light (vl) domain
DVVMTQSPLSLPVTLGQPASISCRSSQSLVHSNTNTYLHWYQQRPGQSPRLLIYKVSNRFSGVPDRFSGSGSGTDFTLKISRVEAEDVGVYFCSQNTHVPPTFGSGTKLEIK

SEQ ID NO: 218 - protein, 16 aa, Artificial Sequence
  Description of Artificial Sequence: Synthetic peptide
  GPC3-A[GPC3]_ L1.6 vlCDR1
RSSQSLVHSNTNTYLH

SEQ ID NO: 219 - protein, 7 aa, Artificial Sequence
  Description of Artificial Sequence: Synthetic peptide
  GPC3-A[GPC3]_ L1.6 vlCDR2
KVSNRFS

SEQ ID NO: 220 - protein, 9 aa, Artificial Sequence
  Description of Artificial Sequence: Synthetic peptide
  GPC3-A[GPC3]_ L1.6 vlCDR3
SQNTHVPPT

SEQ ID NO: 221 - protein, 115 aa, Artificial Sequence; identical to SEQ ID NO: 173
  Description of Artificial Sequence: Synthetic polypeptide
  GPC3-A[GPC3]_ L1.7 Variable light (vl) domain

SEQ ID NO: 222 - protein, 5 aa, Artificial Sequence
  Description of Artificial Sequence: Synthetic peptide
  GPC3-A[GPC3]_ L1.7 vlCDR1
DYEMH

SEQ ID NO: 223 - protein, 17 aa, Artificial Sequence
  Description of Artificial Sequence: Synthetic peptide
  GPC3-A[GPC3]_ L1.7 vlCDR2
ALDPKTGDTAYSQKFQG

SEQ ID NO: 224 - protein, 6 aa, Artificial Sequence
  Description of Artificial Sequence: Synthetic peptide
  GPC3-A[GPC3]_ L1.7 vlCDR3
FYSYTY

SEQ ID NO: 225 - protein, 115 aa, Artificial Sequence; identical to SEQ ID NO: 173
  Description of Artificial Sequence: Synthetic polypeptide
  GPC3-A[GPC3]_ L1.8 Variable light (vl) domain

SEQ ID NO: 226 - protein, 5 aa, Artificial Sequence
  Description of Artificial Sequence: Synthetic peptide
  GPC3-A[GPC3]_ L1.8 vlCDR1
DYEMH

SEQ ID NO: 227 - protein, 17 aa, Artificial Sequence
  Description of Artificial Sequence: Synthetic peptide
  GPC3-A[GPC3]_ L1.8 vlCDR2
ALDPKTGDTAYSQKFQG

SEQ ID NO: 228 - protein, 6 aa, Artificial Sequence
  Description of Artificial Sequence: Synthetic peptide
  GPC3-A[GPC3]_ L1.8 vlCDR3
FYSYTY

SEQ ID NO: 229 - protein, 115 aa, Artificial Sequence; identical to SEQ ID NO: 173
  Description of Artificial Sequence: Synthetic polypeptide
  GPC3-A[GPC3]_ L1.9 Variable light (vl) domain

SEQ ID NO: 230 - protein, 5 aa, Artificial Sequence
  Description of Artificial Sequence: Synthetic peptide
  GPC3-A[GPC3]_ L1.9 vlCDR1
DYEMH

SEQ ID NO: 231 - protein, 17 aa, Artificial Sequence
  Description of Artificial Sequence: Synthetic peptide
  GPC3-A[GPC3]_ L1.9 vlCDR2
ALDPKTGDTAYSQKFQG

SEQ ID NO: 232 - protein, 6 aa, Artificial Sequence
  Description of Artificial Sequence: Synthetic peptide
  GPC3-A[GPC3]_ L1.9 vlCDR3
FYSYTY

SEQ ID NO: 233 - protein, 115 aa, Artificial Sequence; identical to SEQ ID NO: 173
  Description of Artificial Sequence: Synthetic polypeptide
  GPC3-A[GPC3]_ L1.10 Variable light (vl) domain

SEQ ID NO: 234 - protein, 5 aa, Artificial Sequence
  Description of Artificial Sequence: Synthetic peptide
  GPC3-A[GPC3]_ L1.10 vlCDR1
DYEMH

SEQ ID NO: 235 - protein, 17 aa, Artificial Sequence
  Description of Artificial Sequence: Synthetic peptide
  GPC3-A[GPC3]_ L1.10 vlCDR2
ALDPKTGDTAYSQKFQG

SEQ ID NO: 236 - protein, 6 aa, Artificial Sequence
  Description of Artificial Sequence: Synthetic peptide
  GPC3-A[GPC3]_ L1.10 vlCDR3
FYSYTY

SEQ ID NO: 237 - protein, 112 aa, Artificial Sequence
  Description of Artificial Sequence: Synthetic polypeptide
  GPC3-A[GPC3]_ L1.16 Variable light (vl) domain
DVVMTQSPLSLPVTLGQPASISCRSSQSLVHSSGNTYLHWYQQRPGQSPRLLIYKVSNRFSGVPDRFSGSGSGTDFTLKISRVEAEDVGVYFCSQSTHVPPTFGSGTKLEIK

SEQ ID NO: 238 - protein, 16 aa, Artificial Sequence
  Description of Artificial Sequence: Synthetic peptide
  GPC3-A[GPC3]_ L1.16 vlCDR1
RSSQSLVHSSGNTYLH

SEQ ID NO: 239 - protein, 7 aa, Artificial Sequence
  Description of Artificial Sequence: Synthetic peptide
  GPC3-A[GPC3]_ L1.16 vlCDR2
KVSNRFS

SEQ ID NO: 240 - protein, 9 aa, Artificial Sequence
  Description of Artificial Sequence: Synthetic peptide
  GPC3-A[GPC3]_ L1.16 vlCDR3
SQSTHVPPT

SEQ ID NO: 241 - protein, 112 aa, Artificial Sequence
  Description of Artificial Sequence: Synthetic polypeptide
  GPC3-A[GPC3]_ L1.23 Variable light (vl) domain
DVVMTQSPLSLPVTLGQPASISCRSSQSLVHSNGNTWLHWYQQRPGQSPRLLIYKVSNRFSGVPDRFSGSGSGTDFTLKISRVEAEDVGVYFCSQNTHVPPTFGSGTKLEIK

SEQ ID NO: 242 - protein, 16 aa, Artificial Sequence
  Description of Artificial Sequence: Synthetic peptide
  GPC3-A[GPC3]_ L1.23 vlCDR1
RSSQSLVHSNGNTWLH

SEQ ID NO: 243 - protein, 7 aa, Artificial Sequence
  Description of Artificial Sequence: Synthetic peptide
  GPC3-A[GPC3]_ L1.23 vlCDR2
KVSNRFS

SEQ ID NO: 244 - protein, 9 aa, Artificial Sequence
  Description of Artificial Sequence: Synthetic peptide
  GPC3-A[GPC3]_ L1.23 vlCDR3
SQNTHVPPT

SEQ ID NO: 245 - protein, 112 aa, Artificial Sequence
  Description of Artificial Sequence: Synthetic polypeptide
  GPC3-A[GPC3]_ L1.29 Variable light (vl) domain
DVVMTQSPLSLPVTLGQPASISCRSSQSLVHSNGNTYLHWYQQRPGQSPRLLIYQVSNRFSGVPDRFSGSGSGTDFTLKISRVEAEDVGVYFCSQNTHVPPTFGSGTKLEIK

SEQ ID NO: 246 - protein, 16 aa, Artificial Sequence
  Description of Artificial Sequence: Synthetic peptide
  GPC3-A[GPC3]_ L1.29 vlCDR1
RSSQSLVHSNGNTYLH

SEQ ID NO: 247 - protein, 7 aa, Artificial Sequence
  Description of Artificial Sequence: Synthetic peptide
  GPC3-A[GPC3]_ L1.29 vlCDR2
QVSNRFS

SEQ ID NO: 248 - protein, 9 aa, Artificial Sequence
  Description of Artificial Sequence: Synthetic peptide
  GPC3-A[GPC3]_ L1.29 vlCDR3
SQNTHVPPT

SEQ ID NO: 249 - protein, 112 aa, Artificial Sequence
  Description of Artificial Sequence: Synthetic polypeptide
  GPC3-A[GPC3]_ L1.31 Variable light (vl) domain
DVVMTQSPLSLPVTLGQPASISCRSSQSLVHSNGNTYLHWYQQRPGQSPRLLIYYVSNRFSGVPDRFSGSGSGTDFTLKISRVEAEDVGVYFCSQNTHVPPTFGSGTKLEIK

SEQ ID NO: 250 - protein, 16 aa, Artificial Sequence
  Description of Artificial Sequence: Synthetic peptide
  GPC3-A[GPC3]_ L1.31 vlCDR1
RSSQSLVHSNGNTYLH

SEQ ID NO: 251 - protein, 7 aa, Artificial Sequence
  Description of Artificial Sequence: Synthetic peptide
  GPC3-A[GPC3]_ L1.31 vlCDR2
YVSNRFS

SEQ ID NO: 252 - protein, 9 aa, Artificial Sequence
  Description of Artificial Sequence: Synthetic peptide
  GPC3-A[GPC3]_ L1.31 vlCDR3
SQNTHVPPT

SEQ ID NO: 253 - protein, 112 aa, Artificial Sequence
  Description of Artificial Sequence: Synthetic polypeptide
  GPC3-A[GPC3]_ L1.65 Variable light (vl) domain
DVVMTQSPLSLPVTLGQPASISCRSSQSLVHSYGNTWLHWYQQRPGQSPRLLIYKVSNRFSGVPDRFSGSGSGTDFTLKISRVEAEDVGVYFCSQNTHVPPTFGSGTKLEIK

SEQ ID NO: 254 - protein, 16 aa, Artificial Sequence
  Description of Artificial Sequence: Synthetic peptide
  GPC3-A[GPC3]_ L1.65 vlCDR1
RSSQSLVHSYGNTWLH

SEQ ID NO: 255 - protein, 7 aa, Artificial Sequence
  Description of Artificial Sequence: Synthetic peptide
  GPC3-A[GPC3]_ L1.65 vlCDR2
KVSNRFS

SEQ ID NO: 256 - protein, 9 aa, Artificial Sequence
  Description of Artificial Sequence: Synthetic peptide
  GPC3-A[GPC3]_ L1.65 vlCDR3
SQNTHVPPT

SEQ ID NO: 257 - protein, 112 aa, Artificial Sequence
  Description of Artificial Sequence: Synthetic polypeptide
  GPC3-A[GPC3]_ L1.66 Variable light (vl) domain
DVVMTQSPLSLPVTLGQPASISCRSSQSLVHSNANTWLHWYQQRPGQSPRLLIYKVSNRFSGVPDRFSGSGSGTDFTLKISRVEAEDVGVYFCSQNTHVPPTFGSGTKLEIK

SEQ ID NO: 258 - protein, 16 aa, Artificial Sequence
  Description of Artificial Sequence: Synthetic peptide
  GPC3-A[GPC3]_ L1.66 vlCDR1
RSSQSLVHSNANTWLH

SEQ ID NO: 259 - protein, 7 aa, Artificial Sequence
  Description of Artificial Sequence: Synthetic peptide
  GPC3-A[GPC3]_ L1.66 vlCDR2
KVSNRFS

SEQ ID NO: 260 - protein, 9 aa, Artificial Sequence
  Description of Artificial Sequence: Synthetic peptide
  GPC3-A[GPC3]_ L1.66 vlCDR3
SQNTHVPPT

SEQ ID NO: 261 - protein, 112 aa, Artificial Sequence
  Description of Artificial Sequence: Synthetic polypeptide
  GPC3-A[GPC3]_ L1.67 Variable light (vl) domain
DVVMTQSPLSLPVTLGQPASISCRSSQSLVHSNKNTWLHWYQQRPGQSPRLLIYKVSNRFSGVPDRFSGSGSGTDFTLKISRVEAEDVGVYFCSQNTHVPPTFGSGTKLEIK

SEQ ID NO: 262 - protein, 16 aa, Artificial Sequence
  Description of Artificial Sequence: Synthetic peptide
  GPC3-A[GPC3]_ L1.67 vlCDR1
RSSQSLVHSNKNTWLH

SEQ ID NO: 263 - protein, 7 aa, Artificial Sequence
  Description of Artificial Sequence: Synthetic peptide
  GPC3-A[GPC3]_ L1.67 vlCDR2
KVSNRFS

SEQ ID NO: 264 - protein, 9 aa, Artificial Sequence
  Description of Artificial Sequence: Synthetic peptide
  GPC3-A[GPC3]_ L1.67 vlCDR3
SQNTHVPPT

SEQ ID NO: 265 - protein, 112 aa, Artificial Sequence
  Description of Artificial Sequence: Synthetic polypeptide
  GPC3-A[GPC3]_ L1.68 Variable light (vl) domain
DVVMTQSPLSLPVTLGQPASISCRSSQSLVHSYGNTYLHWYQQRPGQSPRLLIYQVSNRFSGVPDRFSGSGSGTDFTLKISRVEAEDVGVYFCSQNTHVPPTFGSGTKLEIK

SEQ ID NO: 266 - protein, 16 aa, Artificial Sequence
  Description of Artificial Sequence: Synthetic peptide
  GPC3-A[GPC3]_ L1.68 vlCDR1
RSSQSLVHSYGNTYLH

SEQ ID NO: 267 - protein, 7 aa, Artificial Sequence
  Description of Artificial Sequence: Synthetic peptide
  GPC3-A[GPC3]_ L1.68 vlCDR2
QVSNRFS

SEQ ID NO: 268 - protein, 9 aa, Artificial Sequence
  Description of Artificial Sequence: Synthetic peptide
  GPC3-A[GPC3]_ L1.68 vlCDR3
SQNTHVPPT

SEQ ID NO: 269 - protein, 112 aa, Artificial Sequence
  Description of Artificial Sequence: Synthetic polypeptide
  GPC3-A[GPC3]_ L1.69 Variable light (vl) domain
DVVMTQSPLSLPVTLGQPASISCRSSQSLVHSNANTYLHWYQQRPGQSPRLLIYQVSNRFSGVPDRFSGSGSGTDFTLKISRVEAEDVGVYFCSQNTHVPPTFGSGTKLEIK

SEQ ID NO: 270 - protein, 16 aa, Artificial Sequence
  Description of Artificial Sequence: Synthetic peptide
  GPC3-A[GPC3]_ L1.69 vlCDR1
RSSQSLVHSNANTYLH

SEQ ID NO: 271 - protein, 7 aa, Artificial Sequence
  Description of Artificial Sequence: Synthetic peptide
  GPC3-A[GPC3]_ L1.69 vlCDR2
QVSNRFS

SEQ ID NO: 272 - protein, 9 aa, Artificial Sequence
  Description of Artificial Sequence: Synthetic peptide
  GPC3-A[GPC3]_ L1.69 vlCDR3
SQNTHVPPT

SEQ ID NO: 273 - protein, 112 aa, Artificial Sequence
  Description of Artificial Sequence: Synthetic polypeptide
  GPC3-A[GPC3]_ L1.70 Variable light (vl) domain
DVVMTQSPLSLPVTLGQPASISCRSSQSLVHSNKNTYLHWYQQRPGQSPRLLIYQVSNRFSGVPDRFSGSGSGTDFTLKISRVEAEDVGVYFCSQNTHVPPTFGSGTKLEIK

SEQ ID NO: 274 - protein, 16 aa, Artificial Sequence
  Description of Artificial Sequence: Synthetic peptide
  GPC3-A[GPC3]_ L1.70 vlCDR1
RSSQSLVHSNKNTYLH

SEQ ID NO: 275 - protein, 7 aa, Artificial Sequence
  Description of Artificial Sequence: Synthetic peptide
  GPC3-A[GPC3]_ L1.70 vlCDR2
QVSNRFS

SEQ ID NO: 276 - protein, 9 aa, Artificial Sequence
  Description of Artificial Sequence: Synthetic peptide
  GPC3-A[GPC3]_ L1.70 vlCDR3
SQNTHVPPT

SEQ ID NO: 277 - protein, 112 aa, Artificial Sequence
  Description of Artificial Sequence: Synthetic polypeptide
  GPC3-A[GPC3]_ L1.71 Variable light (vl) domain
DVVMTQSPLSLPVTLGQPASISCRSSQSLVHSYGNTYLHWYQQRPGQSPRLLIYYVSNRFSGVPDRFSGSGSGTDFTLKISRVEAEDVGVYFCSQNTHVPPTFGSGTKLEIK

SEQ ID NO: 278 - protein, 16 aa, Artificial Sequence
  Description of Artificial Sequence: Synthetic peptide
  GPC3-A[GPC3]_ L1.71 vlCDR1
RSSQSLVHSYGNTYLH

SEQ ID NO: 279 - protein, 7 aa, Artificial Sequence
  Description of Artificial Sequence: Synthetic peptide
  GPC3-A[GPC3]_ L1.71 vlCDR2
YVSNRFS

SEQ ID NO: 280 - protein, 9 aa, Artificial Sequence
  Description of Artificial Sequence: Synthetic peptide
  GPC3-A[GPC3]_ L1.71 vlCDR3
SQNTHVPPT

SEQ ID NO: 281 - protein, 112 aa, Artificial Sequence
  Description of Artificial Sequence: Synthetic polypeptide
  GPC3-A[GPC3]_ L1.72 Variable light (vl) domain
DVVMTQSPLSLPVTLGQPASISCRSSQSLVHSNANTYLHWYQQRPGQSPRLLIYYVSNRFSGVPDRFSGSGSGTDFTLKISRVEAEDVGVYFCSQNTHVPPTFGSGTKLEIK

SEQ ID NO: 282 - protein, 16 aa, Artificial Sequence
  Description of Artificial Sequence: Synthetic peptide
  GPC3-A[GPC3]_ L1.72 vlCDR1
RSSQSLVHSNANTYLH

SEQ ID NO: 283 - protein, 7 aa, Artificial Sequence
  Description of Artificial Sequence: Synthetic peptide
  GPC3-A[GPC3]_ L1.72 vlCDR2
YVSNRFS

SEQ ID NO: 284 - protein, 9 aa, Artificial Sequence
  Description of Artificial Sequence: Synthetic peptide
  GPC3-A[GPC3]_ L1.72 vlCDR3
SQNTHVPPT

SEQ ID NO: 285 - protein, 112 aa, Artificial Sequence
  Description of Artificial Sequence: Synthetic polypeptide
  GPC3-A[GPC3]_ L1.73 Variable light (vl) domain
DVVMTQSPLSLPVTLGQPASISCRSSQSLVHSNKNTYLHWYQQRPGQSPRLLIYYVSNRFSGVPDRFSGSGSGTDFTLKISRVEAEDVGVYFCSQNTHVPPTFGSGTKLEIK

SEQ ID NO: 286 - protein, 16 aa, Artificial Sequence
  Description of Artificial Sequence: Synthetic peptide
  GPC3-A[GPC3]_ L1.73 vlCDR1
RSSQSLVHSNKNTYLH

SEQ ID NO: 287 - protein, 7 aa, Artificial Sequence
  Description of Artificial Sequence: Synthetic peptide
  GPC3-A[GPC3]_ L1.73 vlCDR2
YVSNRFS

SEQ ID NO: 288 - protein, 9 aa, Artificial Sequence
  Description of Artificial Sequence: Synthetic peptide
  GPC3-A[GPC3]_ L1.73 vlCDR3
SQNTHVPPT

SEQ ID NO: 289 - protein, 444 aa, Artificial Sequence
  Description of Artificial Sequence: Synthetic polypeptide
  XENP21969 Chain 1-GPC3-A_H1_[GPC3]_IgG1_PVA_/S267K Heavy Chain
QVQLVQSGAEVKKPGASVKVSCKASGYTFTDYEMHWVRQAPGQGLEWMGALDPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 219 aa, Artificial Sequence
  Description of Artificial Sequence: Synthetic polypeptide
  XENP21969 Chain 2-GPC3-A[GPC3]_L1 Light Chain
DVVMTQSPLSLPVTLGQPASISCRSSQSLVHSNGNTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 291 - protein, 444 aa, Artificial Sequence
  Description of Artificial Sequence: Synthetic polypeptide
  XENP23060 Chain 1-GPC3-A_[GPC3]_H1.1_IgG1_PVA_/S267K Heavy Chain
QVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 219 aa, Artificial Sequence; identical to SEQ ID NO: 290
  Description of Artificial Sequence: Synthetic polypeptide
  XENP23060 Chain 2-GPC3-A_[GPC3]_L1 Light Chain

SEQ ID NO: 293 - protein, 444 aa, Artificial Sequence
  Description of Artificial Sequence: Synthetic polypeptide
  XENP23061 Chain 1-GPC3-A_[GPC3]_H1.2_IgG1_PVA_/S267K Heavy Chain
QVQLVQSGAEVKKPGASVKVSCKASGYTFTDYEMHWVRQAPGQGLEWMGALNPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 219 aa, Artificial Sequence; identical to SEQ ID NO: 290
  Description of Artificial Sequence: Synthetic polypeptide
  XENP23061 Chain 2-GPC3-A_[GPC3]_L1 Light Chain

SEQ ID NO: 295 - protein, 444 aa, Artificial Sequence
  Description of Artificial Sequence: Synthetic polypeptide
  XENP23062 Chain 1-GPC3-A_[GPC3]_H1.3_IgG1_PVA_/S267K Heavy Chain
QVQLVQSGAEVKKPGASVKVSCKASGYTFTDYEMHWVRQAPGQGLEWMGALQPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 219 aa, Artificial Sequence; identical to SEQ ID NO: 290
  Description of Artificial Sequence: Synthetic polypeptide
  XENP23062 Chain 2-GPC3-A_[GPC3]_L1 Light Chain

SEQ ID NO: 297 - protein, 444 aa, Artificial Sequence
  Description of Artificial Sequence: Synthetic polypeptide
  XENP23063 Chain 1-GPC3-A_[GPC3]_H1.4_IgG1_PVA_/S267K Heavy Chain
QVQLVQSGAEVKKPGASVKVSCKASGYTFTDYEMHWVRQAPGQGLEWMGALSPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - protein, 219 aa, Artificial Sequence; identical to SEQ ID NO: 290
  Description of Artificial Sequence: Synthetic polypeptide
  XENP23063 Chain 2-GPC3-A_[GPC3]_L1 Light Chain

SEQ ID NO: 299 - protein, 444 aa, Artificial Sequence; identical to SEQ ID NO: 289
  Description of Artificial Sequence: Synthetic polypeptide
  XENP23064 Chain 1-GPC3-A_[GPC3]_H1_IgG1_PVA_/S267K Heavy Chain

SEQ ID NO: 300 - protein, 219 aa, Artificial Sequence
  Description of Artificial Sequence: Synthetic polypeptide
  XENP23064 Chain 2-GPC3-A_[GPC3]_L1.1 Light Chain
DVVMTQSPLSLPVTLGQPASISCRSSQSLVHSQGNTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 301 - protein, 444 aa, Artificial Sequence; identical to SEQ ID NO: 289
  Description of Artificial Sequence: Synthetic polypeptide
  XENP23065 Chain 1-GPC3-A_[GPC3]_H1_IgG1_PVA_/S267K Heavy Chain

SEQ ID NO: 302 - protein, 219 aa, Artificial Sequence
  Description of Artificial Sequence: Synthetic polypeptide
  XENP23065 Chain 2-GPC3-A_[GPC3]_L1.2 Light Chain
DVVMTQSPLSLPVTLGQPASISCRSSQSLVHSYGNTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 303 - protein, 444 aa, Artificial Sequence; identical to SEQ ID NO: 289
  Description of Artificial Sequence: Synthetic polypeptide
  XENP23066 Chain 1-GPC3-A_[GPC3]_H1_IgG1_PVA_/S267K Heavy Chain

SEQ ID NO: 304 - protein, 219 aa, Artificial Sequence
  Description of Artificial Sequence: Synthetic polypeptide
  XENP23066 Chain 2-GPC3-A_[GPC3]_L1.3 Light Chain
DVVMTQSPLSLPVTLGQPASISCRSSQSLVHSSGNTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 305 - protein, 444 aa, Artificial Sequence; identical to SEQ ID NO: 289
  Description of Artificial Sequence: Synthetic polypeptide
  XENP23067 Chain 1-GPC3-A_[GPC3]_H1_IgG1_PVA_/S267K Heavy Chain

SEQ ID NO: 306 - protein, 219 aa, Artificial Sequence
  Description of Artificial Sequence: Synthetic polypeptide
  XENP23067 Chain 2-GPC3-A_[GPC3]_L1.4 Light Chain
DVVMTQSPLSLPVTLGQPASISCRSSQSLVHSHGNTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 444 aa, Artificial Sequence; identical to SEQ ID NO: 289
  Description of Artificial Sequence: Synthetic polypeptide
  XENP23068 Chain 1-GPC3-A_[GPC3]_H1_IgG1_PVA_/S267K Heavy Chain

SEQ ID NO: 308 - protein, 219 aa, Artificial Sequence
  Description of Artificial Sequence: Synthetic polypeptide
  XENP23068 Chain 2-GPC3-A_[GPC3]_L1.5 Light Chain
DVVMTQSPLSLPVTLGQPASISCRSSQSLVHSNANTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 309 - protein, 444 aa, Artificial Sequence; identical to SEQ ID NO: 289
  Description of Artificial Sequence: Synthetic polypeptide
  XENP23069 Chain 1-GPC3-A_[GPC3]_H1_IgG1_PVA_/S267K Heavy Chain

SEQ ID NO: 310 - protein, 219 aa, Artificial Sequence
  Description of Artificial Sequence: Synthetic polypeptide
  XENP23069 Chain 2-GPC3-A_[GPC3]_L1.6 Light Chain
DVVMTQSPLSLPVTLGQPASISCRSSQSLVHSNTNTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 311 - protein, 444 aa, Artificial Sequence; identical to SEQ ID NO: 289
  Description of Artificial Sequence: Synthetic polypeptide
  XENP23070 Chain 1-GPC3-A_[GPC3]_H1_IgG1_PVA_/S267K Heavy Chain

SEQ ID NO: 312 - protein, 219 aa, Artificial Sequence
  Description of Artificial Sequence: Synthetic polypeptide
  XENP23070 Chain 2-GPC3-A_[GPC3_L1.7 Light Chain
DVVMTQSPLSLPVTLGQPASISCRSSQSLVHSNKNTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 313 - protein, 444 aa, Artificial Sequence; identical to SEQ ID NO: 289
  Description of Artificial Sequence: Synthetic polypeptide
  XENP23071 Chain 1-GPC3-A_[GPC3]_H1_IgG1_PVA_/S267K Heavy Chain

SEQ ID NO: 314 - protein, 219 aa, Artificial Sequence
  Description of Artificial Sequence: Synthetic polypeptide
  XENP23071 Chain 2-GPC3-A_[GPC3]_L1.8 Light Chain
DVVMTQSPLSLPVTLGQPASISCRSSQSLVHSNGQTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 315 - protein, 444 aa, Artificial Sequence; identical to SEQ ID NO: 289
  Description of Artificial Sequence: Synthetic polypeptide
  XENP23072 Chain 1-GPC3-A_[GPC3]_H1_IgG1_PVA_/S267K Heavy Chain

SEQ ID NO: 316 - protein, 219 aa, Artificial Sequence
  Description of Artificial Sequence: Synthetic polypeptide
  XENP23072 Chain 2-GPC3-A_[GPC3]_L1.9 Light Chain
DVVMTQSPLSLPVTLGQPASISCRSSQSLVHSNGYTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 317 - protein, 444 aa, Artificial Sequence; identical to SEQ ID NO: 289
  Description of Artificial Sequence: Synthetic polypeptide
  XENP23073 Chain 1-GPC3-A_[GPC3]_H1_IgG1_PVA_/S267K Heavy Chain

SEQ ID NO: 318 - protein, 219 aa, Artificial Sequence
  Description of Artificial Sequence: Synthetic polypeptide
  XENP23073 Chain 2-GPC3-A_[GPC3]_L1.10 Light Chain
DVVMTQSPLSLPVTLGQPASISCRSSQSLVHSNGHTYLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 319 - protein, 444 aa, Artificial Sequence; identical to SEQ ID NO: 291
  Description of Artificial Sequence: Synthetic polypeptide
  XENP35705 Chain 1-GPC3-A_H1.1_[GPC3]_IgG1_PVA_/S267K Heavy Chain

SEQ ID NO: 320 - protein, 219 aa, Artificial Sequence
  Description of Artificial Sequence: Synthetic polypeptide
  XENP35705 Chain 2-GPC3-A[GPC3]_L1.16 Light Chain
DVVMTQSPLSLPVTLGQPASISCRSSQSLVHSSGNTYLHWYQQRPGQSPRLLIYKVSNRFSGVPDRFSGSGSGTDFTLKISRVEAEDVGVYFCSQSTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 321 - protein, 444 aa, Artificial Sequence; identical to SEQ ID NO: 291
  Description of Artificial Sequence: Synthetic polypeptide
  XENP35708 Chain 1-GPC3-A_H1.1_[GPC3]_IgG1_PVA_/S267K Heavy Chain

SEQ ID NO: 322 - protein, 219 aa, Artificial Sequence
  Description of Artificial Sequence: Synthetic polypeptide
  XENP35708 Chain 2-GPC3-A[GPC3]_L1.31 Light Chain
DVVMTQSPLSLPVTLGQPASISCRSSQSLVHSNGNTYLHWYQQRPGQSPRLLIYYVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 323 - protein, 444 aa, Artificial Sequence
  Description of Artificial Sequence: Synthetic polypeptide
  XENP21971 Chain 1-GPC3-A_H1_IgG1_pI(-)_Isosteric_A_/PVA_/ S267K/L368D/K370S
QVQLVQSGAEVKKPGASVKVSCKASGYTFTDYEMHWVRQAPGQGLEWMGALDPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 324 - protein, 485 aa, Artificial Sequence
  Description of Artificial Sequence: Synthetic polypeptide
  XENP21971 Chain 2-[ANTI-CD3]_H1.30_L1.47_scFv (GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 325 - protein, 219 aa, Artificial Sequence; identical to SEQ ID NO: 290
  Description of Artificial Sequence: Synthetic polypeptide
  XENP21971 Chain 3-GPC3-A_L1_[GPC3]_Light Chain

SEQ ID NO: 326 - protein, 444 aa, Artificial Sequence
  Description of Artificial Sequence: Synthetic polypeptide
  XENP34364 Chain 1-GPC3-A[GPC3]_H1.1_IgG1_pI(-)_Isosteric_A_/PVA_/ S267K/L368D/K370S
QVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 327 - protein, 485 aa, Artificial Sequence; identical to SEQ ID NO: 324
  Description of Artificial Sequence: Synthetic polypeptide
  XENP34364 Chain 2-[ANTI-CD3]_H1.30_L1.47_scFv (GKPGS)4-Fc(216)_IgG1_C220S/PVA_/S267K/S364K/E357Q

SEQ ID NO: 328 - protein, 219 aa, Artificial Sequence; identical to SEQ ID NO: 320
  Description of Artificial Sequence: Synthetic polypeptide
  XENP34364 Chain 3-GPC3-A[GPC3]_L1.16_Light Chain

SEQ ID NO: 329 - protein, 444 aa, Artificial Sequence; identical to SEQ ID NO: 326
  Description of Artificial Sequence: Synthetic polypeptide
  XENP34365 Chain 1-GPC3-A[GPC3]_H1.1_IgG1_pI(-)_Isosteric_A_/PVA_/ S267K/L368D/K370S

SEQ ID NO: 330 - protein, 485 aa, Artificial Sequence; identical to SEQ ID NO: 324
  Description of Artificial Sequence: Synthetic polypeptide
  XENP34365 Chain 2-[ANTI-CD3]_H1.30_L1.47_scFv (GKPGS)4-Fc(216)_IgG1_C220S/PVA_/S267K/S364K/E357Q

SEQ ID NO: 331 - protein, 219 aa, Artificial Sequence
  Description of Artificial Sequence: Synthetic polypeptide
  XENP34365 Chain 3-GPC3-A[GPC3]_L1.23_Light Chain
DVVMTQSPLSLPVTLGQPASISCRSSQSLVHSNGNTWLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - protein, 444 aa, Artificial Sequence; identical to SEQ ID NO: 326
  Description of Artificial Sequence: Synthetic polypeptide
  XENP34367 Chain 1-GPC3-A[GPC3]_H1.1_IgG1_pI(-)_Isosteric_A_/PVA_/ S267K/L368D/K370S

SEQ ID NO: 333 - protein, 485 aa, Artificial Sequence; identical to SEQ ID NO: 324
  Description of Artificial Sequence: Synthetic polypeptide
  XENP34367 Chain 2-[ANTI-CD3]_H1.30_scFv(GKPGS)4-Fc(216)_IgG1_ C220S/PVA_/S267K/S364K/E357Q

SEQ ID NO: 334 - protein, 219 aa, Artificial Sequence
  Description of Artificial Sequence: Synthetic polypeptide
  XENP34367 Chain 3-GPC3-A[GPC3]_L1.29_Light Chain
DVVMTQSPLSLPVTLGQPASISCRSSQSLVHSNGNTYLHWYQQRPGQSPRLLIYQVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - protein, 444 aa, Artificial Sequence; identical to SEQ ID NO: 326
  Description of Artificial Sequence: Synthetic polypeptide
  XENP34368 Chain 1-GPC3-A[GPC3]_H1.1_IgG1_pI(-)_Isosteric_A_/PVA_/ S267K/L368D/K370S

SEQ ID NO: 336 - protein, 485 aa, Artificial Sequence; identical to SEQ ID NO: 324
  Description of Artificial Sequence: Synthetic polypeptide
  XENP34368 Chain 2-GPC3-A[GPC3]_H1.1_Fab-[ANTI-CD3] _H1.30_L1.47_scFv(GKPGS)4-Fc(216)_IgG1_C220S /PVA_/S267K/S364K/E357Q

SEQ ID NO: 337 - protein, 219 aa, Artificial Sequence; identical to SEQ ID NO: 322
  Description of Artificial Sequence: Synthetic polypeptide
  XENP34368 Chain 3-GPC3-A[GPC3]_L1.31_Light Chain

SEQ ID NO: 338 - protein, 444 aa, Artificial Sequence; identical to SEQ ID NO: 326
  Description of Artificial Sequence: Synthetic polypeptide
  XENP35843 Chain 1-GPC3-A[GPC3]_H1.1_IgG1_pI(-)_Isosteric_A_/PVA_/ S267K/L368D/K370S

SEQ ID NO: 339 - protein, 485 aa, Artificial Sequence
  Description of Artificial Sequence: Synthetic polypeptide
  XENP35843 Chain 2-[ANTI-CD3]_H1.32_L1.47_scFv (GKPGS)4-Fc(216)_IgG1_C220S/PVA_/S267K/S364K/E357Q
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 340 - protein, 219 aa, Artificial Sequence; identical to SEQ ID NO: 320
  Description of Artificial Sequence: Synthetic polypeptide
  XENP35843 Chain 3-GPC3-A[GPC3]_L1.16_Light Chain

SEQ ID NO: 341 - protein, 444 aa, Artificial Sequence; identical to SEQ ID NO: 326
  Description of Artificial Sequence: Synthetic polypeptide
  XENP36140 Chain 1-GPC3-A[GPC3]_H1.1_IgG1_pI(-)_Isosteric_A_/PVA_/ S267K/L368D/K370S

SEQ ID NO: 342 - protein, 485 aa, Artificial Sequence; identical to SEQ ID NO: 339
  Description of Artificial Sequence: Synthetic polypeptide
  XENP36140 Chain 2-[ANTI-CD3]_H1.32_L1.47_scFv (GKPGS)4-Fc(216)_IgG1_C220S/PVA_/S267K/S364K/E357Q

SEQ ID NO: 343 - protein, 219 aa, Artificial Sequence; identical to SEQ ID NO: 322
  Description of Artificial Sequence: Synthetic polypeptide
  XENP36140 Chain 3-GPC3-A[GPC3]_L1.31_Light Chain

SEQ ID NO: 344 - protein, 444 aa, Artificial Sequence; identical to SEQ ID NO: 326
  Description of Artificial Sequence: Synthetic polypeptide
  XENP36931 Chain 1-GPC3-A[GPC3]_H1.1_IgG1_pI(-)_Isosteric_A_/PVA_/ S267K/L368D/K370S

SEQ ID NO: 345 - protein, 485 aa, Artificial Sequence; identical to SEQ ID NO: 339
  Description of Artificial Sequence: Synthetic polypeptide
  XENP36931 Chain 2-[ANTI-CD3]_H1.32_L1.47_scFv (GKPGS)4-Fc(216)_IgG1_C220S/PVA_/S267K/S364K/E357Q

SEQ ID NO: 346 - protein, 219 aa, Artificial Sequence
  Description of Artificial Sequence: Synthetic polypeptide
  XENP36931 Chain 3-GPC3-A[GPC3]_L1.65_Light Chain
DVVMTQSPLSLPVTLGQPASISCRSSQSLVHSYGNTWLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 347 - protein, 444 aa, Artificial Sequence; identical to SEQ ID NO: 326
  Description of Artificial Sequence: Synthetic polypeptide
  XENP36932 Chain 1-GPC3-A[GPC3]_H1.1_IgG1_pI(-)_Isosteric_A_/PVA_/ S267K/L368D/K370S

SEQ ID NO: 348 - protein, 485 aa, Artificial Sequence; identical to SEQ ID NO: 339
  Description of Artificial Sequence: Synthetic polypeptide
  XENP36932 Chain 2-[ANTI-CD3]_H1.32_L1.47_scFv (GKPGS)4-Fc(216)_IgG1_C220S/PVA_/S267K/S364K/E357Q

SEQ ID NO: 349 - protein, 219 aa, Artificial Sequence
  Description of Artificial Sequence: Synthetic polypeptide
  XENP36932 Chain 3-GPC3-A[GPC3]_L1.66_Light Chain
DVVMTQSPLSLPVTLGQPASISCRSSQSLVHSNANTWLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 350 - protein, 444 aa, Artificial Sequence; identical to SEQ ID NO: 326
  Description of Artificial Sequence: Synthetic polypeptide
  XENP36933 Chain 1-GPC3-A[GPC3]_H1.1_IgG1_pI(-)_Isosteric_A_/PVA_/ S267K/L368D/K370S

SEQ ID NO: 351 - protein, 485 aa, Artificial Sequence; identical to SEQ ID NO: 339
  Description of Artificial Sequence: Synthetic polypeptide
  XENP36933 Chain 2-[ANTI-CD3]_H1.32_L1.47_scFv (GKPGS)4-Fc(216)_IgG1_C220S/PVA_/S267K/S364K/E357Q

SEQ ID NO: 352 - protein, 219 aa, Artificial Sequence
  Description of Artificial Sequence: Synthetic polypeptide
  XENP36933 Chain 3-GPC3-A[GPC3]_L1.67_Light Chain
DVVMTQSPLSLPVTLGQPASISCRSSQSLVHSNKNTWLHWYQQRPGQSPRLLIYKVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 353 - protein, 444 aa, Artificial Sequence; identical to SEQ ID NO: 326
  Description of Artificial Sequence: Synthetic polypeptide
  XENP36934 Chain 1-GPC3-A[GPC3]_H1.1_IgG1_pI(-)_Isosteric_A_/PVA_/ S267K/L368D/K370S

SEQ ID NO: 354 - protein, 485 aa, Artificial Sequence; identical to SEQ ID NO: 339
  Description of Artificial Sequence: Synthetic polypeptide
  XENP36934 Chain 2-[ANTI-CD3]_H1.32_L1.47_scFv (GKPGS)4-Fc(216)_IgG1_C220S/PVA_/S267K/S364K/E357Q

SEQ ID NO: 355 - protein, 219 aa, Artificial Sequence
  Description of Artificial Sequence: Synthetic polypeptide
  XENP36934 Chain 3-GPC3-A[GPC3]_L1.68_Light Chain
DVVMTQSPLSLPVTLGQPASISCRSSQSLVHSYGNTYLHWYQQRPGQSPRLLIYQVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 356 - protein, 444 aa, Artificial Sequence; identical to SEQ ID NO: 326
  Description of Artificial Sequence: Synthetic polypeptide
  XENP36935 Chain 1-GPC3-A[GPC3]_H1.1_IgG1_pI(-)_Isosteric_A_/PVA_/ S267K/L368D/K370S

SEQ ID NO: 357 - protein, 485 aa, Artificial Sequence; identical to SEQ ID NO: 339
  Description of Artificial Sequence: Synthetic polypeptide
  XENP36935 Chain 2-[ANTI-CD3]_H1.32_L1.47_scFv (GKPGS)4-Fc(216)_IgG1_C220S/PVA_/S267K/S364K/E357Q

SEQ ID NO: 358 - protein, 219 aa, Artificial Sequence
  Description of Artificial Sequence: Synthetic polypeptide
  XENP36935 Chain 3-GPC3-A[GPC3]_L1.69_Light Chain
DVVMTQSPLSLPVTLGQPASISCRSSQSLVHSNANTYLHWYQQRPGQSPRLLIYQVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 359 - protein, 444 aa, Artificial Sequence; identical to SEQ ID NO: 326
  Description of Artificial Sequence: Synthetic polypeptide
  XENP36936 Chain 1-GPC3-A[GPC3]_H1.1_IgG1_pI(-)_Isosteric_A_/PVA_/ S267K/L368D/K370S

SEQ ID NO: 360 - protein, 485 aa, Artificial Sequence; identical to SEQ ID NO: 339
  Description of Artificial Sequence: Synthetic polypeptide
  XENP36936 Chain 2-[ANTI-CD3]_H1.32_L1.47_scFv (GKPGS)4-Fc(216)_IgG1_C220S/PVA_/S267K/S364K/E357Q

SEQ ID NO: 361 - protein, 219 aa, Artificial Sequence
  Description of Artificial Sequence: Synthetic polypeptide
  XENP36936 Chain 3-GPC3-A[GPC3]_L1.70_Light Chain
DVVMTQSPLSLPVTLGQPASISCRSSQSLVHSNKNTYLHWYQQRPGQSPRLLIYQVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 362 - protein, 444 aa, Artificial Sequence; identical to SEQ ID NO: 326
  Description of Artificial Sequence: Synthetic polypeptide
  XENP36937 Chain 1-GPC3-A[GPC3]_H1.1_IgG1_pI(-)_Isosteric_A_/PVA_/ S267K/L368D/K370S

SEQ ID NO: 363 - protein, 485 aa, Artificial Sequence; identical to SEQ ID NO: 339
  Description of Artificial Sequence: Synthetic polypeptide
  XENP36937 Chain 2-[ANTI-CD3]_H1.32_L1.47_scFv (GKPGS)4-Fc(216)_IgG1_C220S/PVA_/S267K/S364K/E357Q

SEQ ID NO: 364 - protein, 219 aa, Artificial Sequence
  Description of Artificial Sequence: Synthetic polypeptide
  XENP36937 Chain 3-GPC3-A[GPC3]_L1.71_Light Chain
DVVMTQSPLSLPVTLGQPASISCRSSQSLVHSYGNTYLHWYQQRPGQSPRLLIYYVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 365 - protein, 444 aa, Artificial Sequence; identical to SEQ ID NO: 326
  Description of Artificial Sequence: Synthetic polypeptide
  XENP36938 Chain 1-GPC3-A[GPC3]_H1.1_IgG1_pI(-)_Isosteric_A_/PVA_/ S267K/L368D/K370S

SEQ ID NO: 366 - protein, 485 aa, Artificial Sequence; identical to SEQ ID NO: 339
  Description of Artificial Sequence: Synthetic polypeptide
  XENP36938 Chain 2-[ANTI-CD3]_H1.32_L1.47_scFv (GKPGS)4-Fc(216)_IgG1_C220S/PVA_/S267K/S364K/E357Q

SEQ ID NO: 367 - protein, 219 aa, Artificial Sequence
  Description of Artificial Sequence: Synthetic polypeptide
  XENP36938 Chain 3-GPC3-A[GPC3]_L1.72_Light Chain
DVVMTQSPLSLPVTLGQPASISCRSSQSLVHSNANTYLHWYQQRPGQSPRLLIYYVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 368 - protein, 444 aa, Artificial Sequence; identical to SEQ ID NO: 326
  Description of Artificial Sequence: Synthetic polypeptide
  XENP36939 Chain 1-GPC3-A[GPC3]_H1.1_IgG1_pI(-)_Isosteric_A_/PVA_/ S267K/L368D/K370S

SEQ ID NO: 369 - protein, 485 aa, Artificial Sequence; identical to SEQ ID NO: 339
  Description of Artificial Sequence: Synthetic polypeptide
  XENP36939 Chain 2-[ANTI-CD3]_H1.32_L1.47_scFv (GKPGS)4-Fc(216)_IgG1_C220S/PVA_/S267K/S364K/E357Q

SEQ ID NO: 370 - protein, 219 aa, Artificial Sequence
  Description of Artificial Sequence: Synthetic polypeptide
  XENP36939 Chain 3-GPC3-A[GPC3]_L1.73_Light Chain
DVVMTQSPLSLPVTLGQPASISCRSSQSLVHSNKNTYLHWYQQRPGQSPRLLIYYVSNRFSGVPDRFSGSGSGTDFTLKISRVEAEDVGVYFCSQNTHVPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 371 - protein, 444 aa, Artificial Sequence; identical to SEQ ID NO: 326
  Description of Artificial Sequence: Synthetic polypeptide
  XENP36941 Chain 1-GPC3-A[GPC3]_H1.1_IgG1_pI(-)_Isosteric_A_/PVA_/ S267K/L368D/K370S

SEQ ID NO: 372 - protein, 485 aa, Artificial Sequence; identical to SEQ ID NO: 339
  Description of Artificial Sequence: Synthetic polypeptide
  XENP36941 Chain 2-[ANTI-CD3]_H1.32_L1.47_scFv (GKPGS)4-Fc(216)_IgG1_C220S/PVA_/S267K/S364K/E357Q

SEQ ID NO: 373 - protein, 219 aa, Artificial Sequence; identical to SEQ ID NO: 334
  Description of Artificial Sequence: Synthetic polypeptide
  XENP36941 Chain 3-GPC3-A[GPC3]_L1.29_Light Chain

SEQ ID NO: 374 - protein, 444 aa, Artificial Sequence
  Description of Artificial Sequence: Synthetic polypeptide
  XENP38087 Chain 1-GPC3-A[GPC3]_H1.1_IgG1_pI(-)_Isosteric_A_/PVA_/ S267K/L368D/K370S/M428L/N434S
QVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 375 - protein, 485 aa, Artificial Sequence
  Description of Artificial Sequence: Synthetic polypeptide
  XENP38087 Chain 2-[ANTI-CD3]_H1.32_L1.47_scFv (GKPGS)4-Fc(216)_IgG1_C220S/PVA_/S267K/S364K/E357Q/M428L/N434S
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 376 - protein, 219 aa, Artificial Sequence; identical to SEQ ID NO: 358
  Description of Artificial Sequence: Synthetic polypeptide
  XENP38087 Chain 3-GPC3-A[GPC3]_L1.69_Light Chain

SEQ ID NO: 377 - protein, 444 aa, Artificial Sequence; identical to SEQ ID NO: 323
  Description of Artificial Sequence: Synthetic polypeptide
  XENP33744 Chain 1-GPC3-A[GPC3]_H1_IgG1_pI(-)_Isosteric_A_/PVA_/ S267K/L368D/K370S

SEQ ID NO: 378 - protein, 717 aa, Artificial Sequence
  Description of Artificial Sequence: Synthetic polypeptide
  XENP33744 Chain 2-GPC3-A[GPC3]_H1_Fab_(G4S)2_[ANTI-CD3] _H1.30_L1.47_scFv(GKPGS)4_(G4S)2-Fc(222)_IgG1_C220S /PVA_/S267K/S364K/E357Q
QVQLVQSGAEVKKPGASVKVSCKASGYTFTDYEMHWVRQAPGQGLEWMGALDPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 379 - protein, 219 aa, Artificial Sequence; identical to SEQ ID NO: 290
  Description of Artificial Sequence: Synthetic polypeptide
  XENP33744 Chain 3-GPC3-A[GPC3]_L1_Light Chain

SEQ ID NO: 380 - protein, 444 aa, Artificial Sequence; identical to SEQ ID NO: 323
  Description of Artificial Sequence: Synthetic polypeptide
  XENP33745 Chain 1-GPC3-A[GPC3]_H1_IgG1_pI(-)_Isosteric_A_/PVA_/ S267K/L368D/K370S

SEQ ID NO: 381 - protein, 717 aa, Artificial Sequence
  Description of Artificial Sequence: Synthetic polypeptide
  XENP33745 Chain 2-GPC3-A[GPC3]_H1_Fab_(G4S)2_[ANTI-CD3] _L1.47_H1.30_scFv(GKPGS)4_(G4S)2-Fc(222)_IgG1_C220S /PVA_/S267K/S364K/E357Q
QVQLVQSGAEVKKPGASVKVSCKASGYTFTDYEMHWVRQAPGQGLEWMGALDPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 382 - protein, 219 aa, Artificial Sequence; identical to SEQ ID NO: 290
  Description of Artificial Sequence: Synthetic polypeptide
  XENP33745 Chain 3-GPC3-A[GPC3]_L1_Light Chain

SEQ ID NO: 383 - protein, 444 aa, Artificial Sequence; identical to SEQ ID NO: 323
  Description of Artificial Sequence: Synthetic polypeptide
  XENP27259 Chain 1-GPC3-A[GPC3]_H1_IgG1_pI(-)_Isosteric_A_/PVA_/ S267K/L368D/K370S

SEQ ID NO: 384 - protein, 717 aa, Artificial Sequence
  Description of Artificial Sequence: Synthetic polypeptide
  XENP27259 Chain 2-GPC3-A[GPC3]_H1_Fab_(G4S)2_[ANTI-CD3] _H1.32_L1.47_scFv(GKPGS)4_(G4S)2-Fc(222)_IgG1_C220S /PVA_/S267K/S364K/E357Q
QVQLVQSGAEVKKPGASVKVSCKASGYTFTDYEMHWVRQAPGQGLEWMGALDPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 385 - protein, 219 aa, Artificial Sequence; identical to SEQ ID NO: 290
  Description of Artificial Sequence: Synthetic polypeptide
  XENP27259 Chain 3-GPC3-A[GPC3]_L1_Light Chain

SEQ ID NO: 386 - protein, 444 aa, Artificial Sequence; identical to SEQ ID NO: 323
  Description of Artificial Sequence: Synthetic polypeptide
  XENP33746 Chain 1-GPC3-A[GPC3]_H1L1_IgG1_pI(-)_Isosteric_A_/PVA_/ S267K/L368D/K370S

SEQ ID NO: 387 - protein, 717 aa, Artificial Sequence
  Description of Artificial Sequence: Synthetic polypeptide
  XENP33746 Chain 2-GPC3-A[GPC3]_H1_Fab_(G4S)2_[ANTI-CD3] _L1.47_H1.32_scFv(GKPGS)4_(G4S)2-Fc(222)_IgG1_C220S /PVA_/S267K/S364K/E357Q
QVQLVQSGAEVKKPGASVKVSCKASGYTFTDYEMHWVRQAPGQGLEWMGALDPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 388 - protein, 219 aa, Artificial Sequence; identical to SEQ ID NO: 290
  Description of Artificial Sequence: Synthetic polypeptide
  XENP33746 Chain 3-GPC3-A[GPC3]_L1_Light Chain

SEQ ID NO: 389 - protein, 444 aa, Artificial Sequence; identical to SEQ ID NO: 326
  Description of Artificial Sequence: Synthetic polypeptide
  XENP34919 Chain 1-GPC3-A[GPC3]_H1.1_IgG1_pI(-)_Isosteric_A_/PVA_/ S267K/L368D/K370S

SEQ ID NO: 390 - protein, 717 aa, Artificial Sequence
  Description of Artificial Sequence: Synthetic polypeptide
  XENP34919 Chain 2-GPC3-A[GPC3]_H1.1_Fab_(G4S)2_[ANTI-CD3] _L1.47_H1.32_scFv(GKPGS)4_(G4S)2-Fc(222)_IgG1_C220S /PVA_/S267K/S364K/E357Q
QVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - protein, 219 aa, Artificial Sequence; identical to SEQ ID NO: 310
  Description of Artificial Sequence: Synthetic polypeptide
  XENP34919 Chain 3-GPC3-A[GPC3]_L1.6_Light Chain

SEQ ID NO: 392 - protein, 444 aa, Artificial Sequence; identical to SEQ ID NO: 326
  Description of Artificial Sequence: Synthetic polypeptide
  XENP34920 Chain 1-GPC3-A[GPC3]_H1.1_IgG1_pI(-)_Isosteric_A_/PVA_/ S267K/L368D/K370S

SEQ ID NO: 393 - protein, 717 aa, Artificial Sequence; identical to SEQ ID NO: 390
  Description of Artificial Sequence: Synthetic polypeptide
  XENP34920 Chain 2-GPC3-A[GPC3]_H1.1_Fab_(G4S)2_[ANTI-CD3] _L1.47_H1.32_scFv(GKPGS)4_(G4S)2-Fc(222)_IgG1_C220S /PVA_/S267K/S364K/E357Q

SEQ ID NO: 394 - protein, 219 aa, Artificial Sequence; identical to SEQ ID NO: 320
  Description of Artificial Sequence: Synthetic polypeptide
  XENP34920 Chain 3-GPC3-A[GPC3]_L1.16_Light Chain

SEQ ID NO: 395 - protein, 444 aa, Artificial Sequence; identical to SEQ ID NO: 326
  Description of Artificial Sequence: Synthetic polypeptide
  XENP34921 Chain 1-GPC3-A[GPC3]_H1.1_IgG1_pI(-)_Isosteric_A_/PVA_/ S267K/L368D/K370S

SEQ ID NO: 396 - protein, 717 aa, Artificial Sequence; identical to SEQ ID NO: 390
  Description of Artificial Sequence: Synthetic polypeptide
  XENP34921 Chain 2-GPC3-A[GPC3]_H1.1_Fab_(G4S)2_[ANTI-CD3] _L1.47_H1.32_scFv(GKPGS)4_(G4S)2-Fc(222)_IgG1_C220S /PVA_/S267K/S364K/E357Q

SEQ ID NO: 397 - protein, 93 aa, Artificial Sequence
  Description of Artificial Sequence: Synthetic polypeptide
  XENP34921 Chain 3-GPC3-A[GPC3]_L1.23_Light Chain
DVVMTQSPLSLPVTLGQPASISCRSSQSLVHSNGNTWLHWYQQRPGQSPRLLIYKVSNRFSGVPDRFSGSGSGTDFTLKISRVEAEDVGVYFC

SEQ ID NO: 398 - protein, 444 aa, Artificial Sequence; identical to SEQ ID NO: 326
  Description of Artificial Sequence: Synthetic polypeptide
  XENP34922 Chain 1-GPC3-A[GPC3]_H1.1_IgG1_pI(-)_Isosteric_A_/PVA_/ S267K/L368D/K370S

SEQ ID NO: 399 - protein, 717 aa, Artificial Sequence; identical to SEQ ID NO: 390
  Description of Artificial Sequence: Synthetic polypeptide
  XENP34922 Chain 2-GPC3-A[GPC3]_H1.1_Fab_(G4S)2_[ANTI-CD3] _L1.47_H1.32_scFv(GKPGS)4_(G4S)2-Fc(222)_IgG1_C220S /PVA_/S267K/S364K/E357Q

SEQ ID NO: 400 - protein, 219 aa, Artificial Sequence; identical to SEQ ID NO: 334
  Description of Artificial Sequence: Synthetic polypeptide
  XENP34922 Chain 3-GPC3-A[GPC3]_L1.29_Light Chain

SEQ ID NO: 401 - protein, 444 aa, Artificial Sequence; identical to SEQ ID NO: 326
  Description of Artificial Sequence: Synthetic polypeptide
  XENP34923 Chain 1-GPC3-A[GPC3]_H1.1_IgG1_pI(-)_Isosteric_A_/PVA_/ S267K/L368D/K370S

SEQ ID NO: 402 - protein, 717 aa, Artificial Sequence; identical to SEQ ID NO: 390
  Description of Artificial Sequence: Synthetic polypeptide
  XENP34923 Chain 2-GPC3-A[GPC3]_H1.1_Fab_(G4S)2_[ANTI-CD3] _L1.47_H1.32_scFv(GKPGS)4_(G4S)2-Fc(222)_IgG1_C220S /PVA_/S267K/S364K/E357Q

SEQ ID NO: 403 - protein, 219 aa, Artificial Sequence; identical to SEQ ID NO: 322
  Description of Artificial Sequence: Synthetic polypeptide
  XENP34923 Chain 3-GPC3-A[GPC3]_L1.31_Light Chain

SEQ ID NO: 404 - protein, 444 aa, Artificial Sequence; identical to SEQ ID NO: 323
  Description of Artificial Sequence: Synthetic polypeptide
  XENP35840 Chain 1-GPC3-A[GPC3]_H1_IgG1_pI(-)_Isosteric_A_/PVA_/ S267K/L368D/K370S

SEQ ID NO: 405 - protein, 717 aa, Artificial Sequence; identical to SEQ ID NO: 384
  Description of Artificial Sequence: Synthetic polypeptide
  XENP35840 Chain 2-GPC3-A[GPC3]_H1_Fab_(G4S)2_[ANTI-CD3] _H1.32_L1.47_scFv(GKPGS)4_(G4S)2-Fc(222)_IgG1_C220S /PVA_/S267K/S364K/E357Q

SEQ ID NO: 406 - protein, 219 aa, Artificial Sequence; identical to SEQ ID NO: 320
  Description of Artificial Sequence: Synthetic polypeptide
  XENP35840 Chain 3-GPC3-A[GPC3]_L1.16_Light Chain

SEQ ID NO: 407 - protein, 219 aa, Artificial Sequence; identical to SEQ ID NO: 320
  Description of Artificial Sequence: Synthetic polypeptide
  XENP35840 Chain 3-GPC3-A[GPC3]_L1.16_Light Chain

SEQ ID NO: 408 - protein, 672 aa, Artificial Sequence
  Description of Artificial Sequence: Synthetic polypeptide
  XENP37246 Chain 1-GPC3-A[GPC3]_H1.1_IgG1_pI(-)_Isosteric_A_/PVA_/ S267K/L368D/K370S
QVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCGGGGSGGGGSQVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 409 - protein, 485 aa, Artificial Sequence; identical to SEQ ID NO: 339
  Description of Artificial Sequence: Synthetic polypeptide
  XENP37246 Chain 2-GPC3-A[GPC3]_H1.1_Fab-[ANTI-CD3] _H1.32_L1.47_scFv(GKPGS)4-Fc(216)_IgG1_C220S /PVA_/S267K/S364K/E357Q

SEQ ID NO: 410 - protein, 219 aa, Artificial Sequence; identical to SEQ ID NO: 320
  Description of Artificial Sequence: Synthetic polypeptide
  XENP37246 Chain 3-GPC3-A[GPC3]_L1.16_Light Chain

SEQ ID NO: 411 - protein, 672 aa, Artificial Sequence; identical to SEQ ID NO: 408
  Description of Artificial Sequence: Synthetic polypeptide
  XENP37247 Chain 1-GPC3-A[GPC3]_H1.1_IgG1_pI(-)_Isosteric_A_/PVA_/ S267K/L368D/K370S

SEQ ID NO: 412 - protein, 485 aa, Artificial Sequence
  Description of Artificial Sequence: Synthetic polypeptide
  XENP37247 Chain 2-GPC3-A[GPC3]_H1.1_Fab-[ANTI-CD3] _L1.47_H1.32_scFv(GKPGS)4-Fc(216)_IgG1_C220S /PVA_/S267K/S364K/E357Q
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 219 aa, Artificial Sequence; identical to SEQ ID NO: 320
  Description of Artificial Sequence: Synthetic polypeptide
  XENP37247 Chain 3-GPC3-A[GPC3]_L1.16_Light Chain

SEQ ID NO: 414 - protein, 444 aa, Artificial Sequence; identical to SEQ ID NO: 374
  Description of Artificial Sequence: Synthetic polypeptide
  XENP38086 Chain 1-GPC3-A[GPC3]_H1.1_IgG1_pI(-)_Isosteric_A_/PVA_/ S267K/L368D/K370S/M428L/N434S

SEQ ID NO: 415 - protein, 717 aa, Artificial Sequence
  Description of Artificial Sequence: Synthetic polypeptide
  XENP38086 Chain 2-GPC3-A[GPC3]_H1.1_Fab_(G4S)2_[ANTI-CD3] _L1.47_H1.32_scFv(GKPGS)4_(G4S)2-Fc(222)_IgG1_C220S /PVA_/S267K/S364K/E357Q/M428L/N434S
QVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 416 - protein, 219 aa, Artificial Sequence; identical to SEQ ID NO: 320
  Description of Artificial Sequence: Synthetic polypeptide
  XENP38086 Chain 3-GPC3-A[GPC3]_L1.16_Light Chain

SEQ ID NO: 417 - protein, 444 aa, Artificial Sequence; identical to SEQ ID NO: 323
  Description of Artificial Sequence: Synthetic polypeptide
  XENP33747 Chain 1-GPC3-A[GPC3]_H1_IgG1_pI(-)_Isosteric_A_/PVA_/ S267K/L368D/K370S

SEQ ID NO: 418 - protein, 713 aa, Artificial Sequence
  Description of Artificial Sequence: Synthetic polypeptide
  XENP33747 Chain 2-GPC3-A[GPC3]_H1_Fab_(G4S)2_[ANTI-CD3] _L1.47_H1.89_scFv(GKPGS)4-Fc(216)_IgG1_C220S/PVA_/S 267K/S364K/E357Q
QVQLVQSGAEVKKPGASVKVSCKASGYTFTDYEMHWVRQAPGQGLEWMGALDPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 419 - protein, 219 aa, Artificial Sequence; identical to SEQ ID NO: 290
  Description of Artificial Sequence: Synthetic polypeptide
  XENP33747 Chain 3-GPC3-A[GPC3]_L1_Light Chain

SEQ ID NO: 420 - protein, 444 aa, Artificial Sequence; identical to SEQ ID NO: 326
  Description of Artificial Sequence: Synthetic polypeptide
  XENP35841 Chain 1-GPC3-A[GPC3]_H1.1_IgG1_pI(-)_Isosteric_A_/PVA_/ S267K/L368D/K370S

SEQ ID NO: 421 - protein, 713 aa, Artificial Sequence
  Description of Artificial Sequence: Synthetic polypeptide
  XENP35841 Chain 2-GPC3-A[GPC3]_H1.1_Fab_(G4S)2_[ANTI-CD3] _L1.47_H1.89_scFv(GKPGS)4_(G4S)2-Fc(222)_IgG1_C220S /PVA_/S267K/S364K/E357Q
QVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 422 - protein, 219 aa, Artificial Sequence; identical to SEQ ID NO: 320
  Description of Artificial Sequence: Synthetic polypeptide
  XENP35841 Chain 3-GPC3-A[GPC3]_L1.16_Light Chain

SEQ ID NO: 423 - protein, 444 aa, Artificial Sequence; identical to SEQ ID NO: 326
  Description of Artificial Sequence: Synthetic polypeptide
  XENP37624 Chain 1-GPC3-A[GPC3]_H1.1_IgG1_pI(-)_Isosteric_A_/PVA_/ S267K/L368D/K370S

SEQ ID NO: 424 - protein, 713 aa, Artificial Sequence; identical to SEQ ID NO: 421
  Description of Artificial Sequence: Synthetic polypeptide
  XENP37624 Chain 2-GPC3-A[GPC3]_H1.1_Fab_(G4S)2_[ANTI-CD3] _L1.47_H1.89_scFv(GKPGS)4_(G4S)2-Fc(222)_IgG1_C220S /PVA_/S267K/S364K/E357Q

SEQ ID NO: 425 - protein, 219 aa, Artificial Sequence; identical to SEQ ID NO: 320
  Description of Artificial Sequence: Synthetic polypeptide
  XENP37624 Chain 3-GPC3-A[GPC3]_L1.16_Light Chain

SEQ ID NO: 426 - protein, 444 aa, Artificial Sequence; identical to SEQ ID NO: 326
  Description of Artificial Sequence: Synthetic polypeptide
  XENP37625 Chain 1-GPC3-A[GPC3]_H1.1_Fab-GPC3- A[GPC3]_IgG1_pI(-)_Isosteric_A_/PVA_/S267K/L368D/K370S

SEQ ID NO: 427 - protein, 713 aa, Artificial Sequence; identical to SEQ ID NO: 421
  Description of Artificial Sequence: Synthetic polypeptide
  XENP37625 Chain 2-GPC3-A[GPC3]_H1.1_L1.69_Fab_(G4S)2_[ANTI-CD3] _L1.47_H1.89_scFv(GKPGS)4-Fc(216)_IgG1_C220S /PVA_/S267K/S364K/E357Q

SEQ ID NO: 428 - protein, 219 aa, Artificial Sequence; identical to SEQ ID NO: 358
  Description of Artificial Sequence: Synthetic polypeptide
  XENP37625 Chain 3-GPC3-A[GPC3]_L1.69_Light Chain

SEQ ID NO: 429 - protein, 444 aa, Artificial Sequence; identical to SEQ ID NO: 326
  Description of Artificial Sequence: Synthetic polypeptide
  XENP37626 Chain 1-GPC3-A[GPC3]_H1.1_IgG1_pI(-)_Isosteric_A_/PVA_/ S267K/L368D/K370S

SEQ ID NO: 430 - protein, 713 aa, Artificial Sequence; identical to SEQ ID NO: 421
  Description of Artificial Sequence: Synthetic polypeptide
  XENP37626 Chain 2-GPC3-A[GPC3]_H1.1_Fab_(G4S)2_[ANTI-CD3] _L1.47_H1.89_scFv(GKPGS)4_(G4S)2-Fc(222)_IgG1_C220S /PVA_/S267K/S364K/E357Q

SEQ ID NO: 431 - protein, 219 aa, Artificial Sequence; identical to SEQ ID NO: 370
  Description of Artificial Sequence: Synthetic polypeptide
  XENP37626 Chain 3-GPC3-A[GPC3]_L1.73_Light Chain

SEQ ID NO: 432 - protein, 444 aa, Artificial Sequence; identical to SEQ ID NO: 374
  Description of Artificial Sequence: Synthetic polypeptide
  XENP38232 Chain 1-GPC3-A[GPC3]_H1.1_IgG1_pI(-)_Isosteric_A_/PVA_/ S267K/L368D/K370S/M428L/N434S

SEQ ID NO: 433 - protein, 713 aa, Artificial Sequence
  Description of Artificial Sequence: Synthetic polypeptide
  XENP38232 Chain 2-GPC3-A[GPC3]_H1.1_Fab_(G4S)2_[ANTI-CD3] _L1.47_H1.89_scFv(GKPGS)4-Fc(216)_IgG1_C220S /PVA_/S267K/S364K/E357Q/M428L/N434S
QVQLVQSGAEVKKPGASVKVSCKASGYTFTDYEMHWVRQAPGQGLEWMGALEPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 434 - protein, 219 aa, Artificial Sequence; identical to SEQ ID NO: 358
  Description of Artificial Sequence: Synthetic polypeptide
  XENP38232 Chain 3-GPC3-A[GPC3]_L1.69_Light Chain

SEQ ID NO: 435 - protein, 444 aa, Artificial Sequence; identical to SEQ ID NO: 326
  Description of Artificial Sequence: Synthetic polypeptide
  XENP37430 Chain 1-GPC3-A[GPC3]_H1.1_IgG1_pI(-)_Isosteric_A_/PVA_/ S267K/L368D/K370S

SEQ ID NO: 436 - protein, 717 aa, Artificial Sequence; identical to SEQ ID NO: 390
  Description of Artificial Sequence: Synthetic polypeptide
  XENP37430 Chain 2-GPC3-A[GPC3]_H1.1_Fab_(G4S)2_[ANTI-CD3] _L1.47_H1.32_scFv(GKPGS)4_(G4S)2-Fc(222)_IgG1_C220S /PVA_/S267K/S364K/E357Q

SEQ ID NO: 437 - protein, 219 aa, Artificial Sequence; identical to SEQ ID NO: 358
  Description of Artificial Sequence: Synthetic polypeptide
  XENP37430 Chain 3-GPC3-A[GPC3]_L1.69_Light Chain

SEQ ID NO: 438 - protein, 444 aa, Artificial Sequence; identical to SEQ ID NO: 326
  Description of Artificial Sequence: Synthetic polypeptide
  XENP37433 Chain 1-GPC3-A[GPC3]_H1.1_IgG1_pI(-)_Isosteric_A_/PVA_/ S267K/L368D/K370S

SEQ ID NO: 439 - protein, 717 aa, Artificial Sequence; identical to SEQ ID NO: 390
  Description of Artificial Sequence: Synthetic polypeptide
  XENP37433 Chain 2-GPC3-A[GPC3]_H1.1_Fab_(G4S)2_[ANTI-CD3] _L1.47_H1.32_scFv(GKPGS)4_(G4S)2-Fc(222)_IgG1_C220S /PVA_/S267K/S364K/E357Q

SEQ ID NO: 440 - protein, 219 aa, Artificial Sequence; identical to SEQ ID NO: 370
  Description of Artificial Sequence: Synthetic polypeptide
  XENP37433 Chain 3-GPC3-A[GPC3]_L1.73_Light Chain

SEQ ID NO: 441 - protein, 444 aa, Artificial Sequence; identical to SEQ ID NO: 323
  Description of Artificial Sequence: Synthetic polypeptide
  XENP33748 Chain 1-GPC3-A[GPC3]_H1_IgG1_pI(-)_Isosteric_A_/PVA_/ S267K/L368D/K370S

SEQ ID NO: 442 - protein, 717 aa, Artificial Sequence
  Description of Artificial Sequence: Synthetic polypeptide
  XENP33748 Chain 2-GPC3-A[GPC3]_H1_Fab_(G4S)2_[ANTI-CD3] _L1.47_H1.33_scFv(GKPGS)4_(G4S)2-Fc(222)_IgG1_C220S /PVA_/S267K/S364K/E357Q
QVQLVQSGAEVKKPGASVKVSCKASGYTFTDYEMHWVRQAPGQGLEWMGALDPKTGDTAYSQKFQGRVTMTADKSISTAYMELSRLRSDDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGKPGSGKPGSGKPGSGKPGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 443 - protein, 219 aa, Artificial Sequence; identical to SEQ ID NO: 290
  Description of Artificial Sequence: Synthetic polypeptide
  XENP33748 Chain 3-GPC3-A[GPC3]_L1_Light Chain

SEQ ID NO: 444 - protein, 444 aa, Artificial Sequence
  Description of Artificial Sequence: Synthetic polypeptide
  XENP31308 Chain 1-GCH065[GPC3]_H0_Fab_ IgG1_pI (-)_Isosteric_A_PVA_/S267K/L368D/K370S
QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 445 - protein, 451 aa, Artificial Sequence
  Description of Artificial Sequence: Synthetic polypeptide
  XENP31308 Chain 2- TR01H113[CD3]_H0_Fab-Fc(222)_IgG1_PVA_/ S267K/S364K/E357Q (222)_IgG1_PVA_/S267K/S364K/E357Q
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 446 - protein, 219 aa, Artificial Sequence
  Description of Artificial Sequence: Synthetic polypeptide
  XENP31308 Chain 3- GCH065[GPC3] L0 Light Chain
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

What is claimed is:

1. A bispecific antibody that binds human CD3 and human GPC3 comprising:
   a) a first monomer comprising the amino acid sequence set forth in SEQ ID NO: 414;
   b) a second monomer comprising the amino acid sequence set forth in SEQ ID NO: 415; and
   c) a third monomer comprising the amino acid sequence set forth in SEQ ID NO: 416.
2. A nucleic acid composition comprising:
   a) a first nucleic acid encoding said first monomer of claim 1;
   b) a second nucleic acid encoding said second monomer claim 1; and
   c) a third nucleic acid encoding said third monomer of claim 1.
3. An expression vector composition comprising:
   a) a first expression vector comprising said first nucleic acid of claim 2;
   b) a second expression vector comprising said second nucleic acid of claim 2; and
   c) a third expression vector comprising said third nucleic acid of claim 2.
4. A host cell comprising said expression vector composition of claim 3.
5. A method of making a bispecific antibody that binds human CD3 and human GPC3 comprising culturing said host cell of claim 4 under conditions wherein said bispecific antibody is expressed, and recovering said bispecific antibody.

* * * * *